(12) United States Patent
DiPersio et al.

(10) Patent No.: US 12,304,941 B2
(45) Date of Patent: May 20, 2025

(54) SUPPRESSION OF CYTOKINE RELEASE SYNDROME IN CHIMERIC ANTIGEN RECEPTOR CELL THERAPY

(71) Applicant: Washington University, St. Louis, MO (US)

(72) Inventors: John DiPersio, St. Louis, MO (US); Matthew Cooper, St. Louis, MO (US); Alun Carter, St. Louis, MO (US)

(73) Assignee: Washington University, St. Louis, MO (US)

( * ) Notice: Subject to any disclaimer, the term of this patent is extended or adjusted under 35 U.S.C. 154(b) by 0 days.

(21) Appl. No.: 17/746,645

(22) Filed: May 17, 2022

(65) Prior Publication Data

US 2023/0074186 A1    Mar. 9, 2023

Related U.S. Application Data

(63) Continuation of application No. 16/428,362, filed on May 31, 2019, now abandoned.

(60) Provisional application No. 62/679,597, filed on Jun. 1, 2018.

(51) Int. Cl.
| | |
|---|---|
| C07K 14/725 | (2006.01) |
| A61K 39/00 | (2006.01) |
| A61K 40/11 | (2025.01) |
| A61K 40/15 | (2025.01) |
| A61K 40/22 | (2025.01) |
| A61K 40/31 | (2025.01) |
| A61K 40/41 | (2025.01) |
| A61K 40/42 | (2025.01) |
| A61P 35/00 | (2006.01) |
| C07K 16/28 | (2006.01) |
| C12N 5/0783 | (2010.01) |
| C12N 15/90 | (2006.01) |

(52) U.S. Cl.
CPC .......... *C07K 14/7051* (2013.01); *A61K 40/11* (2025.01); *A61K 40/15* (2025.01); *A61K 40/22* (2025.01); *A61K 40/31* (2025.01); *A61K 40/418* (2025.01); *A61K 40/4202* (2025.01); *A61K 40/421* (2025.01); *A61K 40/4211* (2025.01); *A61P 35/00* (2018.01); *C07K 16/28* (2013.01); *C12N 5/0636* (2013.01); *C12N 5/0638* (2013.01); *C12N 15/907* (2013.01); *A61K 2239/29* (2023.05); *A61K 2239/31* (2023.05); *A61K 2239/38* (2023.05); *A61K 2239/48* (2023.05); *C12N 2310/20* (2017.05)

(58) Field of Classification Search
CPC ..... A61K 35/17; A61P 35/00; C07K 14/7051; C07K 16/28; C12N 15/907
See application file for complete search history.

(56) References Cited

U.S. PATENT DOCUMENTS

| | | |
|---|---|---|
| 10,494,434 B2 | 12/2019 | Riddell et al. |
| 2015/0202286 A1 | 7/2015 | June et al. |
| 2017/0334964 A1 | 11/2017 | Pulé et al. |
| 2017/0356010 A1 | 12/2017 | Frost et al. |
| 2018/0008638 A1 | 1/2018 | Campana et al. |
| 2018/0371052 A1 | 12/2018 | Ma et al. |
| 2020/0061116 A1 | 2/2020 | Novik et al. |

FOREIGN PATENT DOCUMENTS

| | | | |
|---|---|---|---|
| WO | WO-2015066262 A1 * | 5/2015 | ........... C12N 5/0636 |
| WO | 2017180989 A2 | 10/2017 | |
| WO | 2018027036 A1 | 2/2018 | |
| WO | 2018064602 A1 | 4/2018 | |
| WO | 2018068354 A1 | 4/2018 | |
| WO | 2018073391 A1 | 4/2018 | |
| WO | 2018073393 A2 | 4/2018 | |
| WO | WO-2018132513 A1 * | 7/2018 | ............. A61K 35/17 |
| WO | 2019070680 A2 | 4/2019 | |
| WO | 2019076489 A1 | 4/2019 | |
| WO | 2019099993 A1 | 5/2019 | |
| WO | 2019232425 A1 | 12/2019 | |

OTHER PUBLICATIONS

Giavridis et al. "CAR T cell-induced cytokine release syndrome is mediated by macrophages and abated by IL-1 blockade", Nat Med. Jun. 2018;24(6):731-738 (Year: 2018).*
Eyquem et al. "Targeting a CAR to the TRAC locus with CRISPR/Cas9 enhances tumour rejection", Nature. Mar. 2, 2017;543(7643):113-117 (Year: 2017).*
Ran et al. "Genome engineering using the CRISPR-Cas9 system", Nat Protoc. Nov. 2013; 8(11): 2281-2308 (Year: 2013).*
Rooney et al. "Modeling cytokine release syndrome", Nat Med. Jun. 2018;24(6):705-706 (Year: 2018).*
Cherkassky L., et al., "Human CAR T Cells With Cell-intrinsic PD-1 Checkpoint Blockade Resist Tumor-mediated Inhibition," Journal of clinical investigation, Aug. 2016, vol. 126, No. 8, pp. 3130-3144.
Extended European Search Report for European Application No. 19810633.8, mailed Feb. 21, 2022, 06 Pages.

(Continued)

*Primary Examiner* — Amy E Juedes
*Assistant Examiner* — Peter Johansen
(74) *Attorney, Agent, or Firm* — Polsinelli PC

(57) ABSTRACT

Disclosed herein are methods of gene editing, or endogenous suppression, of cytokines/chemokines/transcription factors secreted from chimeric antigen receptor (CAR)-bearing immune effector cell such as CAR-T cells for the mitigation of cytokine release syndrome and/or CAR-T associated neuropathy. These methods involve insertion of the CAR into a locus of a cytokine gene, blocking its expression. Also disclosed herein are (CAR)-bearing immune effector cells with CARs inserted into a locus of a cytokine gene, and methods of treatment of diseases with immunotherapy with a reduced incidence of cytokine release syndrome and/or CAR-T associated neuropathy.

15 Claims, 11 Drawing Sheets

Specification includes a Sequence Listing.

(56) References Cited

OTHER PUBLICATIONS

Giavridis T., et al., "CAR T Cell-induced Cytokine Release Syndrome is Mediated by Macrophages and Abated by IL-1 Blockade," Nature Medicine, May 28, 2018, Nature Publishing Co., New York, Jun. 2018, vol. 24, No. 6, pp. 731-738, 19 Pages, DOI: 10.1038/S41591-018-0041-7, ISSN 1078-8956, XP036519593.
Heczey A., et al., "Invariant NKT Cells with Chimeric Antigen Receptor Provide a Novel Platform for Safe and Effective Cancer Immunotherapy," Blood, Oct. 30, 2014, vol. 124 (18), pp. 2824-2833.
International Preliminary Report on Patentability for International Application No. PCT/US2019/034981, mailed Dec. 10, 2020, 13 Pages.
International Search Report and Written Opinion for International Application No. PCT/US2019/034981, mailed Oct. 1, 2019, 16 pages.
Karschnia P., et al., "Clinical Presentation, Management, and Biomarkers of Neurotoxicity After Adoptive Immunotherapy with CAR T Cells," Blood, May 16, 2019, vol. 133, No. 20, pp. 2212-2221.
Lee D.W., et al., "Current Concepts in the Diagnosis and Management of Cytokine Release Syndrome," Blood, Jul. 10, 2014, vol. 124, No. 2, pp. 188-195.
Lee D.W., et al., "The Future Is Now: Chimeric Antigen Receptors as New Targeted Therapies for Childhood Cancer," Clinical Cancer Research, May 15, 2012, vol. 18, No. 10, pp. 2780-2790.
Macleod T.D., et al., "Integration of a CD19 CAR into the TCR Alpha Chain Locus Streamlines Production of Allogeneic Gene-Edited CAR T Cells," Molecular Therapy, Apr. 2017, vol. 25 (4), pp. 949-961.
NCBI Reference Sequence NP_001139345.1: "T-Cell Surface Glycoprotein Cd8 Alpha Chain Isoform 1 Precursor [*Homo sapiens*]," NCBI, 3 Pages, [Retrieved on Jun. 7, 2020] Retrieved from URL: https://www.ncbi.nlm.nih.gov/protein/NP_001139345.1.
Neelapu S.S., et al., "Axicabtagene Ciloleucel CAR T-Cell Therapy in Refractory Large B-Cell Lymphoma," New England Journal of Medicine, Dec. 28, 2017, vol. 377, No. 26, pp. 2531-2544.
Norelli M., et al., "Monocyte-Derived IL-1 and IL-6 Are Differentially Required for Cytokine-Release Syndrome and Neurotoxicity Due to CAR T Cells," Nature Medicine, Jun. 2018, vol. 24, pp. 739-748, 16 Pages.
Parajuli B., et al., "GM-CSF Increases LPS-induced Production of Proinflammatory Mediators via Upregulation of TLR4 and CD14 in Murine Microglia," Journal of Neuroinflammation, Dec. 13, 2012, vol. 9, No. 268, 12 Pages.
Prudent V., et al., "Chimeric Antigen Receptor T-cell Neuropsychiatric Toxicity in Acute Lymphoblastic Leukemia," Published in final edited form as: Palliat Support Care, HHS Public Access Author Manuscript, Aug. 1, 2017, vol. 15, No. 4, pp. 499-503, 7 Pages.
Sachdeva M., et al., "Granulocyte-macrophage Colony-stimulating Factor Inactivation in CAR T-Cells Prevents Monocyte-dependent Release of Key Cytokine Release Syndrome Mediators," Journal of Biological Chemistry, Feb. 25, 2019, vol. 294, No. 14, pp. 5430-5437.
Santomasso B., et al., "Biomarkers Associated with Neurotoxicity in Adult Patients with Relapsed or Refractory B-ALL (R/R B-ALL) Treated with CD19 CAR T Cells," Journal of Clinical Oncology, May 30, 2017, vol. 35, No. 15, p. 3019 (2 Pages).
Shearer R.F., et al., "Experimental Design for Stable Genetic Manipulation in Mammalian Cell Lines: Lentivirus and Alternatives," Genes to Cells, 2015, vol. 20, pp. 1-10.
Sterner R.M., et al., "GM-CSF Blockade during Chimeric Antigen Receptor T Cell Therapy Reduces Cytokine Release Syndrome and Neurotoxicity and May Enhance Their Effector Functions," American Society of Hematology Annual Meeting, Oral and Poster Abstracts, Session 703, Adoptive Immunotherapy: Preclinical Studies to Improve Safety and Efficacy of CAR-T Cells, Dec. 3, 2018, 3 Pages.
Sterner R.M., et al., "GM-CSF Inhibition Reduces Cytokine Release Syndrome and Neuroinflammation but Enhances CAR-T Cell Function in Xenografts," Blood, Feb. 14, 2019, vol. 133, No. 7, pp. 697-709.
U.S. Department of Health and Human Services, "Common Terminology Criteria for Adverse Events (CTCAE)," National Institutes of Health, National Cancer Institute, NIH Publication 09-5410, Version 4.03, Jun. 14, 2010, 196 pages.
Xu X-J., et al., "Cytokine Release Syndrome in Cancer Immunotherapy with Chimeric Antigen Receptor Engineered T cells," Cancer Letters, Feb. 28, 2014, vol. 343, No. 2, pp. 172-178.
Zheng W., et al., "Modulation of PI3K Signaling to Improve CAR T Cell Function," Oncotarget, 2018, vol. 9 (88), pp. 35807-35808.

* cited by examiner

FIG. 11

ELISA plate layout - IL6 CAR GMCSF KO experiment 24 hr

| | Standard | | Controls | | | | CAR19 Control | | | CAR19 GM-CSF KO | | |
|---|---|---|---|---|---|---|---|---|---|---|---|---|
| | 1 | 2 | 3 | 4 | 5 | 6 | 7 | 8 | 9 | 10 | 11 | 12 |
| A | STD1 300 | STD1 300 | CAR19 T cells (50K) | | CAR19 (50K) + Act MQ (5K) | CAR19 (50K) + Act MQ | CAR19 (50K) + iDC + Beads | | | CAR19 GM-CSF (50K) + iDC + Beads | | |
| B | STD2 100 | STD2 100 | iDC (1K) | | CAR19 (50K) + RAMOS (5K) | CAR19 (50K) + MQ | CAR19 (50K) + iDC + RAMOS | | | CAR19 GM-CSF (50K) + iDC + RAMOS | | |
| C | STD3 50 | STD3 50 | Beads (50K) | | CAR19 (50K) + RAMOS (50K) | | CAR19 (50K) + Act MQ + RAMOS | | | CAR19 GM-CSF (50K) + Act MQ + RAMOS | | |
| D | STD4 25 | STD4 25 | Activated MQ (5K) | | iDC (1K) + Beads (50K) | | CAR19 (50K) + MQ + RAMOS | | | CAR19 GM-CSF (50K) + MQ + RAMOS | | |
| E | STD5 12.5 | STD5 12.5 | MQ (5K) | | Act MQ (5K) + Beads (50K) | | CAR19 (12.5K) + iDC + Beads | | | CAR19 GM-CSF (12.5K) + iDC + Beads | | |
| F | STD6 6.25 | STD6 6.25 | RAMOS (50K) | | MQ (5K) + Beads (50K) | | CAR19 (12.5K) + iDC + RAMOS | | | CAR19 GM-CSF (12.5K) + iDC + RAMOS | | |
| G | STD7 3.125 | STD7 3.125 | CAR19 (50K) + iDC (1K) | | CAR19 (50K) + iDC (1K) | | CAR19 (12.5K) + Act MQ + RAMOS | | | CAR19 GM-CSF (12.5K) + Act MQ + RAMOS | | |
| H | STD8 0 | STD8 0 | CAR19 (50K) + Beads (50K) | | CAR19 (50K) + Beads (50K) | | CAR19 (12.5K) + MQ + RAMOS | | | CAR19 GM-CSF (12.5K) + MQ + RAMOS | | |

FIG. 12a results of ELISA (top half) - IL6 CAR GMCSF KO experiment 24 hr

|   | 1 | 2 | 3 | 4 | 5 | 6 | 7 | 8 | 9 | 10 | 11 | 12 |   |
|---|---|---|---|---|---|---|---|---|---|----|----|----|---|
| A | 2.139 | 2.206 | 0.084 | 0.079 | 0.1 | 0.099 | 0.782 | 0.871 | 0.738 | 0.452 | 0.475 | 0.472 | 450 [test] |
|   | 0.082 | 0.076 | 0.055 | 0.048 | 0.044 | 0.046 | 0.055 | 0.058 | 0.055 | 0.079 | 0.05 | 0.051 | 540 [test] |
|   | 11.427 | 11.833 | 0.162 | 0.171 | 0.308 | 0.296 | 4.043 | 4.517 | 3.797 | 2.07 | 2.363 | 2.341 | pathlength |
|   | 2.141 | 2.202 | 0.084 | 0.079 | 0.1 | 0.099 | 0.782 | 0.87 | 0.742 | 0.453 | 0.478 | 0.476 | 450 |
|   | 0.083 | 0.076 | 0.054 | 0.048 | 0.044 | 0.046 | 0.054 | 0.058 | 0.055 | 0.079 | 0.05 | 0.051 | 540 |
|   | 0.187 | 0.186 | 0.52 | 0.462 | 0.325 | 0.335 | 0.193 | 0.192 | 0.195 | 0.219 | 0.202 | 0.203 | corrected [450] |
|   | 0.007 | 0.006 | 0.335 | 0.281 | 0.144 | 0.154 | 0.013 | 0.013 | 0.015 | 0.038 | 0.021 | 0.022 | corrected [540] |
| B | 0.806 | 0.833 | 0.083 | 0.073 | 0.081 | 0.084 | 0.274 | 0.301 | 0.324 | 0.248 | 0.235 | 0.236 | 630 [test] |
|   | 0.054 | 0.053 | 0.054 | 0.044 | 0.044 | 0.046 | 0.053 | 0.046 | 0.049 | 0.047 | 0.047 | 0.049 | 720 [test] |
|   | 4.177 | 4.331 | 0.159 | 0.164 | 0.206 | 0.21 | 1.226 | 1.416 | 1.532 | 1.116 | 1.047 | 1.041 | pathlength |
|   | 0.805 | 0.835 | 0.083 | 0.073 | 0.081 | 0.084 | 0.275 | 0.301 | 0.338 | 0.249 | 0.236 | 0.238 | 630 |
|   | 0.054 | 0.053 | 0.054 | 0.044 | 0.044 | 0.046 | 0.054 | 0.046 | 0.062 | 0.047 | 0.047 | 0.049 | 720 |
|   | 0.193 | 0.193 | 0.522 | 0.447 | 0.395 | 0.4 | 0.224 | 0.213 | 0.221 | 0.223 | 0.226 | 0.229 | corrected [450] |
|   | 0.013 | 0.012 | 0.342 | 0.267 | 0.215 | 0.217 | 0.044 | 0.033 | 0.04 | 0.042 | 0.045 | 0.047 | corrected [540] |
| C | 0.47 | 0.458 | 0.076 | 0.097 | 0.112 | 0.119 | 0.187 | 0.195 | 0.205 | 0.193 | 0.226 | 0.217 | 810 [test] |
|   | 0.049 | 0.048 | 0.048 | 0.045 | 0.045 | 0.044 | 0.046 | 0.045 | 0.052 | 0.047 | 0.047 | 0.047 | 900 [test] |
|   | 2.357 | 2.28 | 0.153 | 0.139 | 0.371 | 0.416 | 0.784 | 0.831 | 0.847 | 0.812 | 0.993 | 0.948 | pathlength |
|   | 0.469 | 0.458 | 0.076 | 0.07 | 0.112 | 0.119 | 0.187 | 0.195 | 0.205 | 0.194 | 0.226 | 0.218 | 810 |
|   | 0.049 | 0.048 | 0.049 | 0.045 | 0.046 | 0.044 | 0.046 | 0.046 | 0.053 | 0.047 | 0.048 | 0.049 | 900 |
|   | 0.291 | 0.201 | 0.496 | 0.507 | 0.302 | 0.286 | 0.239 | 0.235 | 0.242 | 0.239 | 0.228 | 0.23 | corrected [450] |
|   | 0.021 | 0.021 | 0.316 | 0.325 | 0.123 | 0.107 | 0.059 | 0.055 | 0.063 | 0.058 | 0.048 | 0.05 | corrected [540] |
| D | 0.271 | 0.277 | 0.087 | 0.086 | 0.071 | 0.079 | 0.252 | 0.267 | 0.291 | 0.234 | 0.242 | 0.254 | 990 [test] |
|   | 0.048 | 0.047 | 0.044 | 0.046 | 0.044 | 0.052 | 0.051 | 0.05 | 0.06 | 0.047 | 0.045 | 0.046 | 1080 [test] |
|   | 1.236 | 1.281 | 0.243 | 0.218 | 0.151 | 0.149 | 1.113 | 1.206 | 1.281 | 1.038 | 1.091 | 1.151 | pathlength |
|   | 0.272 | 0.277 | 0.087 | 0.085 | 0.071 | 0.079 | 0.252 | 0.268 | 0.292 | 0.234 | 0.242 | 0.253 | 990 |
|   | 0.049 | 0.047 | 0.044 | 0.046 | 0.045 | 0.053 | 0.051 | 0.051 | 0.062 | 0.048 | 0.046 | 0.047 | 1080 |
|   | 0.22 | 0.216 | 0.36 | 0.391 | 0.474 | 0.531 | 0.226 | 0.223 | 0.228 | 0.225 | 0.222 | 0.22 | corrected [450] |
|   | 0.039 | 0.037 | 0.182 | 0.212 | 0.298 | 0.354 | 0.046 | 0.042 | 0.048 | 0.046 | 0.042 | 0.041 | corrected [540] |

FIG. 12b results of ELISA (bottom half) - IL6 CAR GMCSF KO experiment 24 hr

| | 1 | 2 | 3 | 4 | 5 | 6 | 7 | 8 | 9 | 10 | 11 | 12 | |
|---|---|---|---|---|---|---|---|---|---|---|---|---|---|
| E | 0.172 | 0.17 | 0.073 | 0.075 | 0.085 | 0.084 | 0.492 | 0.557 | 0.42 | 0.18 | 0.247 | 0.19 | 450 [test] |
| | 0.046 | 0.045 | 0.044 | 0.046 | 0.045 | 0.045 | 0.05 | 0.053 | 0.05 | 0.048 | 0.048 | 0.047 | 540 [test] |
| | 0.698 | 0.691 | 0.161 | 0.161 | 0.222 | 0.216 | 2.46 | 2.796 | 2.054 | 0.735 | 1.107 | 0.794 | pathlength |
| | 0.171 | 0.17 | 0.073 | 0.075 | 0.085 | 0.084 | 0.496 | 0.558 | 0.42 | 0.181 | 0.249 | 0.19 | 450 |
| | 0.046 | 0.046 | 0.045 | 0.047 | 0.045 | 0.045 | 0.05 | 0.053 | 0.051 | 0.048 | 0.049 | 0.047 | 540 |
| | 0.245 | 0.246 | 0.454 | 0.468 | 0.533 | 0.399 | 0.202 | 0.2 | 0.204 | 0.246 | 0.225 | 0.239 | corrected [450] |
| | 0.066 | 0.066 | 0.277 | 0.291 | 0.203 | 0.209 | 0.02 | 0.019 | 0.025 | 0.066 | 0.044 | 0.059 | corrected [540] |
| F | 0.127 | 0.124 | 0.07 | 0.074 | 0.075 | 0.072 | 0.148 | 0.143 | 0.128 | 0.102 | 0.115 | 0.121 | 630 [test] |
| | 0.044 | 0.045 | 0.045 | 0.047 | 0.046 | 0.044 | 0.055 | 0.057 | 0.045 | 0.045 | 0.051 | 0.048 | 720 [test] |
| | 0.458 | 0.436 | 0.147 | 0.15 | 0.162 | 0.157 | 0.516 | 0.479 | 0.463 | 0.316 | 0.353 | 0.406 | pathlength |
| | 0.127 | 0.124 | 0.07 | 0.074 | 0.075 | 0.072 | 0.147 | 0.144 | 0.129 | 0.102 | 0.116 | 0.12 | 630 |
| | 0.045 | 0.045 | 0.046 | 0.047 | 0.046 | 0.044 | 0.055 | 0.057 | 0.045 | 0.045 | 0.052 | 0.048 | 720 |
| | 0.277 | 0.283 | 0.475 | 0.493 | 0.495 | 0.462 | 0.286 | 0.3 | 0.278 | 0.323 | 0.328 | 0.296 | corrected [450] |
| | 0.097 | 0.104 | 0.297 | 0.314 | 0.285 | 0.283 | 0.106 | 0.119 | 0.097 | 0.144 | 0.147 | 0.119 | corrected [540] |
| G | 0.098 | 0.1 | 0.078 | 0.073 | 0.104 | 0.122 | 0.143 | 0.169 | 0.144 | 0.125 | 0.134 | 0.131 | 810 [test] |
| | 0.044 | 0.044 | 0.046 | 0.044 | 0.045 | 0.05 | 0.049 | 0.049 | 0.05 | 0.05 | 0.045 | 0.046 | 900 [test] |
| | 0.301 | 0.313 | 0.179 | 0.161 | 0.326 | 0.398 | 0.523 | 0.667 | 0.523 | 0.415 | 0.493 | 0.469 | pathlength |
| | 0.099 | 0.101 | 0.078 | 0.073 | 0.103 | 0.122 | 0.144 | 0.169 | 0.144 | 0.125 | 0.133 | 0.13 | 810 |
| | 0.044 | 0.044 | 0.046 | 0.044 | 0.045 | 0.05 | 0.05 | 0.049 | 0.05 | 0.05 | 0.045 | 0.045 | 900 |
| | 0.328 | 0.322 | 0.437 | 0.452 | 0.317 | 0.306 | 0.275 | 0.254 | 0.275 | 0.301 | 0.269 | 0.277 | corrected [450] |
| | 0.148 | 0.142 | 0.259 | 0.272 | 0.138 | 0.127 | 0.095 | 0.074 | 0.096 | 0.12 | 0.091 | 0.096 | corrected [540] |
| H | 0.082 | 0.087 | 0.113 | 0.12 | 0.074 | 0.081 | 0.165 | 0.169 | 0.15 | 0.103 | 0.122 | 0.119 | 990 [test] |
| | 0.047 | 0.051 | 0.049 | 0.047 | 0.047 | 0.053 | 0.055 | 0.059 | 0.045 | 0.044 | 0.046 | 0.044 | 1080 [test] |
| | 0.197 | 0.336 | 0.356 | 0.406 | 0.15 | 0.157 | 0.611 | 0.607 | 0.579 | 0.329 | 0.422 | 0.412 | pathlength |
| | 0.082 | 0.087 | 0.113 | 0.12 | 0.074 | 0.081 | 0.165 | 0.169 | 0.15 | 0.103 | 0.122 | 0.118 | 990 |
| | 0.047 | 0.052 | 0.049 | 0.047 | 0.047 | 0.053 | 0.055 | 0.06 | 0.046 | 0.044 | 0.046 | 0.045 | 1080 |
| | 0.415 | 0.443 | 0.316 | 0.296 | 0.493 | 0.516 | 0.27 | 0.279 | 0.259 | 0.314 | 0.289 | 0.288 | corrected [450] |
| | 0.236 | 0.263 | 0.137 | 0.117 | 0.311 | 0.338 | 0.09 | 0.098 | 0.079 | 0.134 | 0.11 | 0.109 | corrected [540] |

SUPPRESSION OF CYTOKINE RELEASE SYNDROME IN CHIMERIC ANTIGEN RECEPTOR CELL THERAPY

This application claims the benefit of U.S. Provisional Application No. 62/679,597, filed Jun. 1, 2018, the disclosure of which is hereby incorporated by reference in its entirety.

SEQUENCE LISTING

The instant application contains a Sequence Listing which has been submitted electronically in ASCII format and is hereby incorporated by reference in its entirety. Said ASCII copy, created on Aug. 6, 2019, is named WGN0003-401-PC_SL.txt and is 956,834 bytes in size.

CAR-T cells have emerged as a promising therapy for the treatment of hematological malignancies. Despite remarkable clinical efficacy against B cell malignancies, the success of CAR-T therapy has been limited by severe, life-threatening toxicities, observed in over 50% of patients. These toxicities have resulted in several deaths leading to early termination of clinical trial. Toxicities primarily manifest as cytokine release syndrome (CRS, also referred to as "cytokine storm") characterized by high elevations of cytokines including INFγ, granulocyte-macrophage colony-stimulating factor, IL-10, and IL-6. These cytokine elevations result in a plethora of clinical symptoms including fever, hypotension, organ dysfunction, respiratory failure and coagulopathy. CRS can be fatal. Additionally, neurotoxicity often presents even after the initial symptoms of CRS have subsided. The pathogenesis of CRS and associated neurotoxicity is poorly understood and further understanding of the mechanism would be useful for the successful translation of CAR-T therapy. In the meanwhile, disrupting the pathogenesis of CRS by reducing the level of cytokine genes available for expression is one way to mitigate the condition.

Disclosed herein are methods of gene deletion and endogenous suppression, of cytokines/chemokines/transcription factors secreted from chimeric antigen receptor (CAR)-bearing immune effector cell, such as CAR-T cell, for the mitigation of cytokine release syndrome and/or CAR-T associated neuropathy. These gene deletion methods may include, but are not limited to, insertion of the CAR into a locus of a cytokine/chemokine/transcription factor gene, blocking its expression; gene editing with Transcription Activator-like Effector Nucleases (TALENs), Zinc Finger Nucleases (ZFNs), or CRISPR; expression of an scFv with an endoplasmic reticulum (ER) binding tether to bind the cytokine in the ER and prevent secretion; and transfection of small hairpin RNAs (shRNAs) or small interfering RNAs (siRNAs). Also disclosed herein are CAR-bearing immune effector cells modified with these described cytokine/chemokine/transcription factor gene deletion methods, and methods of treatment of diseases with immunotherapy with a reduced incidence of cytokine release syndrome (CRS) and/or CAR-T associated neuropathy (CAN).

BRIEF DESCRIPTION OF THE DRAWINGS

FIG. 11—Shows a set-up of an ELISA plate for detecting specific markers of CAR-T cells.

FIG. 12a and FIG. 12b—Shows the results for an ELISA assay detecting specific markers of the CAR-T cells. FIG. 12a shows the top half of the ELISA plate, and FIG. 12b shows the bottom half of the plate. In each of rows A-H, from top to bottom, the sub-rows indicate test, ref, Pathlength, 450, 540, Corrected [450], and Corrected [540].

DETAILED DESCRIPTION

Figure 1:
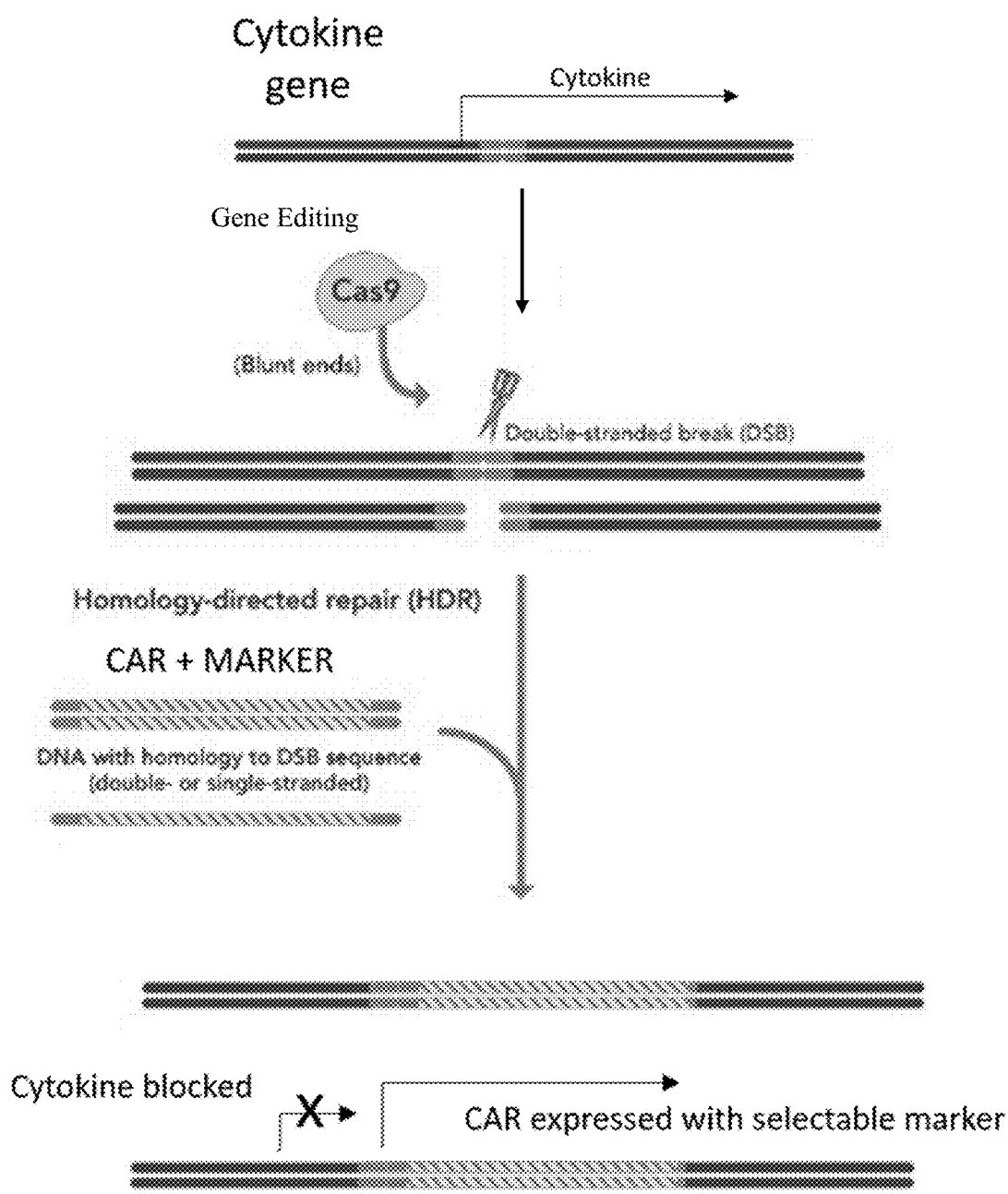
FIG. 1—Illustrates the concept of inserting a CAR into the gene for a cytokine in order to block its translation, thereby deleting it or reducing its level, thus preventing or reducing cytokine release syndrome and/or CAR-bearing immune effector cell associated neuropathy (CAR-T associated neuropathy).

Accordingly, disclosed herein as Embodiment 1 is a chimeric antigen receptor (CAR)-bearing immune effector cell that is deficient in a cytokine or in a chemokine or in a transcription factor that is involved in cytokine release syndrome.

The following disclosure will detail embodiments, alternatives, and uses of the cytokine-deficient cells, as well as the use of such cells in, for example, immunotherapy and adoptive cell transfer for the treatment of diseases. Accordingly, provided herein are the following additional embodiments.

Embodiment 2—The cell as recited in embodiment 1, wherein the cytokine or chemokine or transcription factor deficiency is effected by deletion or suppression of a gene encoding the cytokine or chemokine or transcription factor.

Embodiment 3—The cell as recited in any of embodiments 1 or 2, wherein the deletion or suppression is effected by inserting the CAR into a locus of the cytokine or chemokine or transcription factor gene.

Embodiment 4—The cell as recited in any of embodiments 1 to 3, wherein the CAR is part of a construct that also includes a selectable marker.

Embodiment 5—The cell as recited in any of embodiments 1 to 4, wherein the selectable marker comprises a green fluorescence (GFP) gene, a yellow fluorescent (YFP) gene, a truncated CD34 (tCD34) gene, or a truncated EGFR (tEGFR) gene.

Embodiment 6—The cell as recited in any of embodiments 1 to 5, wherein the cytokine or chemokine or transcription factor deficiency is effected by deletion or suppression of the cytokine or chemokine gene, by Transcription Activator-like Effector Nucleases (TALENs), Zinc Finger Nucleases (ZFNs), or Clustered Regularly Interspaced Short Palindromic Repeats (CRISPR) editing.

Embodiment 7—The cell as recited in any of embodiments 1 to 6, wherein deletion or suppression is effected using CRISPR.

Embodiment 8—The cell as recited in any of embodiments 1 to 7, wherein deletion or suppression is effected using Cas9-CRISPR.

Embodiment 9—The cell as recited in any of embodiments 1 to 8, wherein the Cas9 is delivered into the cell as mRNA or protein.

Embodiment 10—The cell as recited in any of embodiments 1 to 9, wherein the Cas9 is delivered into the cell as mRNA.

Embodiment 11—The cell as recited in any of embodiments 1 to 10, wherein the Cas9 is delivered into the cell as protein.

Embodiment 12—The cell as recited in any of embodiments 1 to 11, wherein a guide RNA (gRNA) targeting the gene to be deleted or suppressed is delivered contemporaneously with the Cas9.

Embodiment 13—The cell as recited in any of embodiments 1 to 12, wherein the delivery is by electroporation.

Embodiment 14—The cell as recited in any of embodiments 1 to 13, wherein the cytokine or chemokine or transcription factor deficiency is effected by suppression of the cytokine or chemokine or transcription factor gene transcript by transfection of one or more types of small interfering RNAs (siRNA).

Embodiment 15—The cell as recited in any of embodiments 1 to 14, wherein the cytokine or chemokine or transcription factor deficiency is effected by suppression of the cytokine or chemokine or transcription factor gene transcript by transduction of one or more types of short hairpin RNAs (shRNA).

Embodiment 16—A chimeric antigen receptor (CAR)-bearing immune effector cell expressing at least one CAR, wherein:
  the at least one CAR is inserted into a locus of a cytokine or chemokine or transcription factor gene or transcription factor gene;
  the cytokine or chemokine or transcription factor gene is deleted or suppressed by a method chosen from Transcription Activator-like Effector Nucleases (TALENs), Zinc Finger Nucleases (ZFNs), and Clustered Regularly Interspaces Short Palindromic Repeats (CRISPR) editing;
  the cytokine or chemokine or transcription factor is suppressed by expression of an scFv with an endoplasmic reticulum (ER) binding tether to bind the cytokine or chemokine in the ER and prevent secretion;
  the cytokine or chemokine or transcription factor gene transcript is suppressed by transfection of small interfering RNAs (siRNAs); or
  the cytokine or chemokine or transcription factor gene transcript is suppressed by transduction of short hairpin RNAs (shRNAs).

Embodiment 17—The cell as recited in any of embodiments 1 to 16, wherein the cell is chosen from a chimeric antigen receptor T cell (CAR-T), a CAR-bearing iNKT cell (INKT-CAR), and a CAR-bearing natural killer (NK) cell (NK-CAR), or a CAR-bearing macrophage.

Embodiment 18—The cell as recited in any of embodiments 1 to 17, wherein the cell is a CAR-T.

Embodiment 19—The cell as recited in any of embodiments 1 to 18, wherein the cell is a dual or tandem CAR-T.

Embodiment 20—The cell as recited in any of embodiments 1 to 17, wherein the cell is an iNKT-CAR.

Embodiment 21—The cell as recited in any of embodiments 1 to 20, wherein the cell is a dual or tandem iNKT-CAR.

Embodiment 22—The cell as recited in any of embodiments 1 to 17, wherein the cell is a CAR-macrophage.

Embodiment 23—The cell as recited in any of embodiments 1 to 22, wherein the cell is a dual or tandem CAR-macrophage.

Embodiment 24—The cell as recited in any of embodiments 1 to 23, wherein the cytokine or chemokine or transcription factor contributes to the development of cytokine release syndrome.

Embodiment 25—The cell as recited in any of embodiments 1 to 24, wherein the cytokine or chemokine or transcription factor is selected from among those recited in Table 10.

Embodiment 26—The cell as recited in any of embodiments 1 to 25, wherein the cytokine or chemokine or transcription factor is produced by T cells that activate or localize myeloid cells.

Embodiment 27—The cell as recited in any of embodiments 1 to 26, wherein the cytokine or chemokine or transcription factor is a T cell surface receptor gene that activates myeloid or CAR-T cells.

Embodiment 28—The cell as recited in any of embodiments 1 to 27, wherein the gene that is deleted or suppressed is a T cell surface receptor that is integrated into CAR-T cell signaling.

Embodiment 29—The cell as recited in any of embodiments 1 to 28, wherein the cytokine or chemokine or transcription factor drives T cell/CAR-T cell differentiation.

Embodiment 30—The cell as recited in any of embodiments 1 to 29, wherein the cytokine or chemokine is a transcription factor that drives T cell/CAR-T cell differentiation.

Embodiment 31—The cell as recited in any of embodiments 1 to 30, wherein the cytokine or chemokine or transcription factor is chosen from MCP1 (CCL2), MCP-2, GM-CSF, G-CSF, M-CSF, Il-4, and IFNγ.

Embodiment 32—The cell as recited in any of embodiments 1 to 31, wherein the cytokine or chemokine or transcription factor is GM-CSF.

Embodiment 33—The cell as recited in any of embodiments 1 to 32, wherein the cell is a GM-CSF deficient CAR-T cell.

Embodiment 34—The cell as recited in any of embodiments 1 to 33, wherein the cell is a GM-CSF deficient iNKT-CAR cell.

Embodiment 35—The cell as recited in any of embodiments 1 to 34, wherein the immune effector cells to be used are harvested from a healthy donor.

Embodiment 36—The cell as recited in any of embodiments 1 to 35, wherein the donor is a human.

Embodiment 37—The cell as recited in any of embodiments 1 to 36, wherein the chimeric antigen receptor(s) specifically binds at least one antigen expressed on a malignant cell.

Embodiment 38—The cell as recited in any of embodiments 1 to 37, wherein the one or more antigens expressed on a malignant cell is chosen from BCMA, CS1, CD38, CD138, CD19, CD33, CD123, CD371, CD117, CD135, Tim-3, CD5, CD7, CD2, CD4, CD3, CD79A, CD79B, APRIL, CD56, and CD1a.

Embodiment 39—The cell as recited in any of embodiments 1 to 38, wherein the chimeric antigen receptor specifically binds at least one antigen expressed on a malignant T cell.

Embodiment 40—The cell as recited in any of embodiments 1 to 39, wherein the antigen is selected from CD2, CD3&, CD4, CD5, CD7, TCRA, and TCRβ.

Embodiment 41—The cell as recited in any of embodiments 1 to 38, wherein the chimeric antigen receptor specifically binds at least one antigen expressed on a malignant B cell.

Embodiment 42—The cell as recited in any of embodiments 1 to 41, wherein the antigen is selected from CD19, CD20, CD21, CD22, CD23, CD24, CD25, CD27, CD38, and CD45.

Embodiment 43—The cell as recited in any of embodiments 1 to 42, wherein the antigen is selected from CD19 and CD20.

Embodiment 44—The cell as recited in any of embodiments 1 to 38, wherein the chimeric antigen receptor specifically binds at least one antigen expressed on a malignant mesothelial cell.

Embodiment 45—The cell as recited in any of embodiments 1 to 44, wherein the antigen is mesothelin.

Embodiment 46—The cell as recited in any of embodiments 1 to 38, wherein the chimeric antigen receptor specifically binds at least one antigen expressed on a malignant plasma cell.

Embodiment 47—The cell as recited in any of embodiments 1 to 46, wherein the antigen is selected from BCMA, CS1, CD38, and CD19.

Embodiment 48—The cell as recited in any of embodiments 1 to 47, wherein the chimeric antigen receptor expresses the extracellular portion of the APRIL protein, the ligand for BCMA and TACI, effectively co-targeting both BCMA and TACI.

Embodiment 49—The cell as recited in any of embodiments 1 to 48, wherein the CAR-T cell further comprises a suicide gene.

Embodiment 50—The cell as recited in any of embodiments 1 to 49, wherein endogenous T cell receptor mediated signaling is negligible in the cell.

Embodiment 51—The cell as recited in any of embodiments 1 to 50, wherein the cell does not induce alloreactivity or graft-versus-host disease.

Embodiment 52—The cell as recited in any of embodiments 1 to 51, wherein the cell does not induce fratricide.

Embodiment 53-A method of treatment of cancer in a patient, which has a reduced incidence of cytokine release syndrome and/or CAR-T associated neuropathy, comprising the administration of cells as recited in any of embodiments 1 to 52.

Embodiment 54—The method as recited in embodiment 53, wherein the cancer is a hematologic malignancy.

Embodiment 55—The method as recited in any of embodiments 53 to 54, wherein the hematologic malignancy is a T-cell malignancy.

Embodiment 56—The method as recited in any of embodiments 53 to 55, wherein the T cell malignancy is T-cell acute lymphoblastic leukemia (T-ALL).

Embodiment 57—The method as recited in any of embodiments 53 to 56, wherein the T cell malignancy is non-Hodgkin's lymphoma.

Embodiment 58—The method as recited in any of embodiments 53 to 57, wherein the hematologic malignancy is multiple myeloma.

Embodiment 59—The method as recited in any of embodiments 53 to 58, wherein the hematologic malignancy is AML.

Embodiment 60—The method as recited in any of embodiments 53 to 59, wherein the cancer is a solid tumor.

Embodiment 61—The method as recited any of embodiments 53 to 60, wherein the cancer is cervical cancer, pancreatic cancer, ovarian cancer, mesothelioma, and lung cancer.

Embodiment 62-A method of prevention or reduction of cytokine release syndrome or CAR-T associated neuropathy in a patient receiving chimeric antigen receptor T cell (CAR-T), CAR-bearing iNKT cell (INKT-CAR), CAR-bearing natural killer (NK) cell (NK-CAR), or CAR-bearing macrophage (CAR-macrophage) immunotherapy, comprising the administration of cells as recited in any of embodiments 53 to 61 as the immunotherapy.

Embodiment 63—The method of any of embodiments 53 to 62, wherein the patient is being treated for cancer.

Embodiment 64—The method as recited in any of embodiments 53 to 63, wherein the cancer is a hematologic malignancy.

Embodiment 65—The method as recited in any of embodiments 53 to 64, wherein the hematologic malignancy is a T-cell malignancy.

Embodiment 66—The method as recited in any of embodiments 53 to 65, wherein the T cell malignancy is T-cell acute lymphoblastic leukemia (T-ALL).

Embodiment 67—The method as recited in any of embodiments 53 to 66, wherein the T cell malignancy is non-Hodgkin's lymphoma.

Embodiment 68—The method as recited in any of embodiments 53 to 67, wherein the hematologic malignancy is multiple myeloma.

Embodiment 69—The method as recited in any of embodiments 53 to 68, wherein the hematologic malignancy is AML.

Embodiment 70—The method as recited in any of embodiments 53 to 69, wherein the cancer is a solid tumor.

Embodiment 71—The method as recited in any of embodiments 53 to 70, wherein the cancer is cervical cancer, pancreatic cancer, ovarian cancer, mesothelioma, and lung cancer.

Embodiment 72—A method of blocking the expression of a cytokine gene or chemokine gene or transcription factor gene in a chimeric antigen receptor T cell (CAR-T), CAR-bearing iNKT cell (INKT-CAR), CAR-bearing natural killer (NK) cell (NK-CAR), or CAR-bearing macrophage (CAR-macrophage) comprising the insertion of a CAR into a locus of the cytokine gene or chemokine gene or transcription factor gene.

Embodiment 73—The method of any of embodiments 53 to 72, wherein blocking the expression of the cytokine gene or chemokine gene or transcription factor gene does not reduce CAR-T cell-mediated killing.

Embodiment 74—A method of making a CAR-T (immune effector) cell that does not cause or contribute to CRS or CAR-T-associated neuropathy (CAN) comprising deleting or suppressing a cytokine or chemokine or transcription factor gene.

Embodiment 75—The method of any of embodiments 53 to 74, wherein deleting or suppressing the cytokine or chemokine or transcription factor gene does not reduce CAR-T cell-mediated killing.

Embodiment 76—The method as recited in any of embodiments 53 to 75, wherein the deletion or suppression is effected by inserting the CAR into a locus of the cytokine or chemokine or transcription factor gene.

Embodiment 77—The method as recited in any of embodiments 53 to 76, wherein the CAR is part of a construct that also includes a selectable marker.

Embodiment 78—The method as recited in any of embodiments 53 to 77, wherein the selectable marker comprises a green fluorescence (GFP) gene, a YFP gene, a tCD34 gene, or a tEGFR gene.

Embodiment 79—The method of any of embodiments 53 to 78, wherein the insertion of a CAR with a selectable marker into the cytokine or chemokine or transcription factor gene allows a single-step purification of TCR-negative cells.

Embodiment 80—The method of any of embodiments 53 to 79, wherein the insertion of a CAR with a selectable marker into the cytokine or chemokine or transcription factor gene allows a single step purification of CAR+ cytokine negative cells.

Embodiment 81—The method as recited in any of embodiments 53 to 80, wherein the deletion or suppression is effected using Transcription Activator-like Effector Nucleases (TALENs), Zinc Finger Nucleases (ZFNs), or Clustered Regularly Interspaced Short Palindromic Repeats (CRISPR) editing.

Embodiment 82—The method as recited in any of embodiments 53 to 81, wherein the deletion or suppression is effected using CRISPR.

Embodiment 83—The method as recited in any of embodiments 53 to 82, wherein the deletion or suppression is effected using Cas9-CRISPR.

Embodiment 84—The method as recited in any of embodiments 53 to 83, wherein the Cas9 is delivered into the cell as mRNA or protein.

Embodiment 85—The method as recited in any of embodiments 53 to 84, wherein the Cas9 is delivered into the cell as mRNA.

Embodiment 86—The method as recited in any of embodiments 53 to 85, wherein the Cas9 is delivered into the cell as protein.

Embodiment 87—The method as recited in any of embodiments 53 to 86, wherein a guide RNA (gRNA) targeting the gene to be deleted or suppressed is delivered contemporaneously with the Cas9.

Embodiment 88—The method as recited in any of embodiments 53 to 87, wherein the delivery is by electroporation.

Embodiment 89—The method as recited in any of embodiments 53 to 88, wherein the deletion or suppression is effected by suppression of the cytokine or chemokine or transcription factor gene transcript by transduction of one or more types of short hairpin RNAs (shRNA).

Embodiment 90—The method as recited in any of embodiments531 to 89, wherein the deletion or suppression is effected by transducing a construct encoding a protein expression blocker (PEBL).

Embodiment 91—The method of any of embodiments 53 to 90, wherein the construct encodes an antibody-derived single-chain variable fragment specific for the cytokine, chemokine or TF gene.

Embodiment 92—The method of any of embodiments 53 to 91, wherein deletion of the cytokine, chemokine, or transcription factor gene does not reduce CAR-T-mediated killing.

Embodiment 93—The method of any of embodiments 53 to 92, wherein the CAR to be inserted comprises a donor template.

Embodiment 94—The method of any of embodiments 53 to 93, wherein donor template comprises an adeno-associated virus (AAV), a single-stranded DNA, or a double-stranded DNA.

Disclosed herein is a chimeric antigen receptor (CAR)-bearing immune effector cell that is deficient in a cytokine.

In certain embodiments, the cytokine deficiency is effected by ablation of a cytokine gene or a chemokine gene, or a transcription factor gene.

In certain embodiments, the ablation is effected by inserting the CAR into a locus of the cytokine/chemokine/transcription factor gene.

In certain embodiments, the CAR is part of a construct that also includes a selectable marker.

In certain embodiments, the cytokine deficiency is effected by deletion or suppression of the cytokine/chemokine/transcription factor gene, by Transcription Activator-like Effector Nucleases (TALENs), Zinc Finger Nucleases (ZFNs), or Clustered Regularly Interspaces Short Palindromic Repeats (CRISPR) editing.

In certain embodiments, the cytokine deficiency is effected by suppression of the cytokine/chemokine/transcription factor gene transcript by transfection of small interfering RNAs (siRNAs).

Also disclosed herein is a chimeric antigen receptor (CAR)-bearing immune effector cell expressing at least one CAR, wherein:
  the at least one CAR is inserted into a locus of a cytokine/chemokine/transcription factor gene;
  the cytokine/chemokine/transcription factor gene is deleted or suppressed by a method chosen from Transcription Activator-like Effector Nucleases (TALENs), Zinc Finger Nucleases (ZFNs), and Clustered Regularly Interspaces Short Palindromic Repeats (CRISPR) editing;
  the cytokine is suppressed by expression of an scFv with an endoplasmic reticulum (ER) binding tether to bind the cytokine in the ER and prevent secretion; or
  the cytokine/chemokine/transcription factor gene transcript is suppressed by small interfering RNAs (siRNAs) transfection.

In certain embodiments, the cell is chosen from a chimeric antigen receptor T cell (CAR-T), a CAR-bearing iNKT cell (iNKT-CAR), and a CAR-bearing natural killer (NK) cell (NK-CAR).

In certain embodiments, the cell is a CAR-T.

In certain embodiments, the cell is a dual or tandem CAR-T.

In certain embodiments, the cell is an iNKT-CAR.

In certain embodiments, the cell is a dual or tandem iNKT-CAR.

In certain embodiments, the cytokine contributes to the development of cytokine release syndrome.

In certain embodiments, the cytokine is chosen from MCP1 (CCL2), MCP-2, GM-CSF, G-CSF, M-CSF, IL-4, and IFNγ.

In certain embodiments, the cytokine is GM-CSF.

In certain embodiments, the cell is a GM-CSF deficient CAR-T cell.

In certain embodiments, the cell is a GM-CSF deficient iNKT-CAR cell.

In certain embodiments, the chimeric antigen receptor specifically binds at least one antigen expressed on a malignant T cell.

In certain embodiments, the antigen is selected from CD2, CD3&, CD4, CD5, CD7, TCRA, and TCRβ.

In certain embodiments, the chimeric antigen receptor specifically binds at least one antigen expressed on a malignant B cell.

In certain embodiments, the antigen is selected from CD19 and CD20.

In certain embodiments, the chimeric antigen receptor specifically binds at least one antigen expressed on a malignant mesothelial cell.

In certain embodiments, the antigen is mesothelin.

In certain embodiments, the chimeric antigen receptor specifically binds at least one antigen expressed on a malignant plasma cell.

In certain embodiments, the antigen is selected from BCMA, CS1, CD38, and CD19.

In certain embodiments, the chimeric antigen receptor expresses the extracellular portion of the APRIL protein, the ligand for BCMA and TACI, effectively co-targeting both BCMA and TACI.

In certain embodiments, the CAR-T cell further comprises a suicide gene.

In certain embodiments, endogenous T cell receptor mediated signaling is negligible in the cell.

In certain embodiments, the cell does not induce alloreactivity or graft-versus-host disease.

In certain embodiments, the cell does not induce fratricide.

Also disclosed herein is a method of treatment of cancer in a patient, which has a reduced incidence of cytokine release syndrome and/or CAR-T associated neuropathy, comprising the administration of chimeric antigen receptor (CAR)-bearing immune effector cells as disclosed herein.

In certain embodiments, the cancer is a hematologic malignancy.

In certain embodiments, the hematologic malignancy is a T-cell malignancy.

In certain embodiments, the T cell malignancy is T-cell acute lymphoblastic leukemia (T-ALL).

In certain embodiments, the T cell malignancy is non-Hodgkin's lymphoma.

In certain embodiments, the hematologic malignancy is multiple myeloma.

In certain embodiments, the cancer is a solid tumor.

In certain embodiments, the cancer is cervical cancer, pancreatic cancer, ovarian cancer, mesothelioma, and lung cancer.

Also disclosed herein is a method of prevention or reduction of cytokine release syndrome, CAR-T associated neuropathy in a patient receiving chimeric antigen receptor T cell (CAR-T), CAR-bearing iNKT cell (INKT-CAR), or CAR-bearing natural killer (NK) cell (NK-CAR) immunotherapy, comprising the administration of chimeric antigen receptor (CAR)-bearing immune effector cells as disclosed herein as the immunotherapy.

Also disclosed herein is a method of blocking the expression of a cytokine/chemokine/transcription factor gene in a chimeric antigen receptor T cell (CAR-T), CAR-bearing iNKT cell (INKT-CAR), or CAR-bearing natural killer (NK) cell (NK-CAR), comprising the insertion of a CAR into a locus of the cytokine/chemokine/transcription factor gene.

CAR-Bearing Immune Effector Cells

A chimeric antigen receptor (CAR), is a recombinant fusion protein comprising: 1) an extracellular ligand-binding domain, i.e., an antigen-recognition domain, 2) a transmembrane domain, and 3) a signaling transducing domain.

Methods for CAR design, delivery and expression, and the manufacturing of clinical-grade CAR-T cell populations are known in the art. See, for example, Lee et al., *Clin. Cancer Res.*, 2012, 18 (10): 2780-90. An engineered chimeric antigen receptor polynucleotide that encodes for a CAR comprises: a signal peptide, an antigen recognition domain, at least one co-stimulatory domain, and a signaling domain.

The antigen-specific extracellular domain of a chimeric antigen receptor recognizes and specifically binds an antigen, typically a surface-expressed antigen of a malignancy. An "antigen-specific extracellular domain" (or, equivalently, "antigen-binding domain") specifically binds an antigen when, for example, it binds the antigen with an affinity constant or affinity of interaction (KD) between about 0.1 pM to about 10 µM, preferably about 0.1 pM to about 1 µM, more preferably about 0.1 pM to about 100 nM. Methods for determining the affinity of interaction are known in the art. An antigen-specific extracellular domain suitable for use in a CAR of the present disclosure may be any antigen-binding polypeptide, a wide variety of which are known in the art. In some instances, the antigen-binding domain is a single chain Fv (scFv). Other antibody based recognition domains (cAb VHH (camelid antibody variable domains) and humanized versions thereof, IgNAR VH (shark antibody variable domains) and humanized versions thereof, sdAb VH (single domain antibody variable domains) and "camelized" antibody variable domains are suitable for use. In some instances, T-cell receptor (TCR) based recognition domains such as single chain TCR (scTv, single chain two-domain TCR containing VαVβ) are also suitable for use.

A chimeric antigen receptor of the present disclosure also comprises an "intracellular domain" that provides an intracellular signal to the CAR-bearing immune effector cell upon antigen binding to the antigen-specific extracellular domain. The intracellular signaling domain of a chimeric antigen receptor of the present disclosure is responsible for activation of at least one of the effector functions of the T cell in which the chimeric receptor is expressed. The term "effector function" refers to a specialized function of a differentiated cell, such as an iNKT cell. An effector function of an iNKT cell, for example, may be NK transactivation, T cell activation and differentiation, B cell activation, dendritic cell activation and cross-presentation activity, and macrophage activation. Thus, the term "intracellular domain" refers to the portion of a CAR that transduces the effector function signal upon binding of an antigen to the extracellular domain and directs the iNKT cell to perform a specialized function. Non-limiting examples of suitable intracellular domains include the zeta chain of the T-cell receptor or any of its homologs (e.g., eta, delta, gamma, or epsilon), MB 1 chain, 829, Fe RIII, Fe R1, and combinations of signaling molecules, such as CD35 and CD28, CD27, 4-1 BB, DAP-1 0, OX40, and combinations thereof, as well as other similar molecules and fragments. Intracellular signaling portions of other members of the families of activating proteins may be used, such as FcγRIII and FcεRI. While usually the entire intracellular domain will be employed, in many cases it will not be necessary to use the entire intracellular polypeptide. To the extent that a truncated portion of the intracellular signaling domain may find use, such truncated portion may be used in place of the intact chain as long as it still transduces the effector function signal. The term intracellular domain is thus meant to include any truncated portion of the intracellular domain sufficient to transduce the effector function signal.

Typically, the antigen-specific extracellular domain is linked to the intracellular domain of the chimeric antigen receptor by a "transmembrane domain." A transmembrane domain traverses the cell membrane, anchors the CAR to the T cell surface, and connects the extracellular domain to the intracellular signaling domain, thus impacting expression of the CAR on the T cell surface. Chimeric antigen receptors may also further comprise one or more costimulatory domain and/or one or more spacer. A "costimulatory domain" is derived from the intracellular signaling domains of costimulatory proteins that enhance cytokine production, proliferation, cytotoxicity, and/or persistence in vivo. A "peptide hinge" connects the antigen-specific extracellular domain to the transmembrane domain. The transmembrane domain is fused to the costimulatory domain, optionally a costimulatory domain is fused to a second costimulatory domain, and the costimulatory domain is fused to a signaling domain, not limited to CD32. For example, inclusion of a spacer domain between the antigen-specific extracellular domain and the transmembrane domain, and between multiple scFvs in the case of tandem CAR, may affect flexibility of the antigen-binding domain(s) and thereby CAR function. Suitable transmembrane domains, costimulatory domains, and spacers are known in the art.

Engineered CARs may be introduced into CAR-bearing immune effector cells using retroviruses, which efficiently and stably integrate a nucleic acid sequence encoding the chimeric antigen receptor into the target cell genome. Other methods known in the art include, but are not limited to, lentiviral transduction, transposon-based systems, direct RNA transfection, and CRISPR/Cas systems (e.g., type I, type II, or type III systems using a suitable Cas protein such Cas3, Cas4, Cas5, Cas5e (or CasD), Cas6, Cas6e, Cas6f, Cas7, Cas8a1, Cas8a2, Cas8b, Cas8c, Cas9, Cas10, Cas1 0d, CasF, CasG, CasH, Csy1, Csy2, Csy3, Cse1 (or CasA), Cse2 (or CasB), Cse3 (or CasE), Cse4 (or CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csz1, Csx15, Csf1, Csf2, Csf3, Csf4, and Cu1966, etc.). Zinc finger nucleases (ZFNs) and transcription activator-like effector nucleases (TALENs) may also be used. See, e.g., Shearer RF and Saunders DN, "Experimental design for stable genetic manipulation in mammalian cell lines: lentivirus and alternatives," *Genes Cells* 2015 January;20 (1): 1-10.

Manipulation of PI3K signaling can be used to prevent altered CAR-T cell differentiation due to constitutive CAR self-signaling and foster long-lived memory T cell development. pharmacologic blockade of PI3K during CAR-T manufacture and ex vivo expansion can abrogate preferential effector T cell development and restore CAR-T effector/memory ratio to that observed in empty vector transduced T cells, which can improve in vivo T cell persistence and therapeutic activity. Inhibition of p110δ PI3K can enhance efficacy and memory in tumor-specific therapeutic CD8 T cells, while inhibition of p110α PI3K can increase cytokine production and antitumor response.

This is proposed to be because the presence of a CAR on a T cell's surface can alter its activation and differentiation, even in the absence of ligand. Constitutive self-signaling through CAR, related to both the scFv framework and the signaling domains, can lead to aberrant T cell behavior, including altered differentiation and decreased survival. This is significant as the effectiveness of CAR-T cells in patients is directly associated with their in vivo longevity. The presence of the CD28 costimulatory domain increased CAR-T cell exhaustion induced by persistent CAR self-signaling; the 4-1BB costimulatory domain had a lesser effect. Furthermore, CD3-zeta significantly enhances the constitutive activation of the PI3K, AKT, mTOR, and glycolysis pathways, and fostered formation of short-lived effector cells over central/stem memory cells. See, e.g., Zhang W. et al., "Modulation of PI3K signaling to improve CAR T cell function," *Oncotarget*, 2018 Nov. 9; 9 (88): 35807-35808.

CAR Antigens. Suitable antigens to be genome-edited in the iNKT cells disclosed herein, and to be recognized by the CARs of INKT-CARs disclosed herein, include antigens specific to hematologic malignancies. These can include T cell-specific antigens and/or antigens that are not specific to T cells. The antigen may be specifically bound by the chimeric antigen receptor of an iNKT-CARs cell, and the antigen for which the iNKT-CARs cell is deficient, is an antigen expressed on a malignant T cell, preferably an antigen that is overexpressed on malignant T cell (i.e., a T cell derived from a T-cell malignancy) in comparison to a nonmalignant T cell. Examples of such antigens include CD2, CD3&, CD4, CD5, CD7, TRAC, and TCRβ.

T-cell malignancies comprise malignancies derived from T-cell precursors, mature T cells, or natural killer cells. Examples of T-cell malignancies include T-cell acute lymphoblastic leukemia/lymphoma (T-ALL), T-cell large granular lymphocyte (LGL) leukemia, human T-cell leukemia virus type 1-positive (HTLV-1+) adult T-cell leukemia/lymphoma (ATL), T-cell prolymphocytic leukemia (T-PLL), and various peripheral T-cell lymphomas (PTCLs), including but not limited to angioimmunoblastic T-cell lymphoma (AITL), ALK-positive anaplastic large cell lymphoma, and ALK-negative anaplastic large cell lymphoma.

Suitable CAR antigens can also include antigens found on the surface of a multiple myeloma cell, i.e., a malignant plasma cell, such as BCMA, CS1, CD38, and CD19. Alternatively, the CAR may be designed to express the extracellular portion of the APRIL protein, the ligand for BCMA and TACI, effectively co-targeting both BCMA and TACI for the treatment of multiple myeloma.

Additional examples of suitable antigens to be genome-edited in the iNKT cells disclosed herein, and to be recognized by the CARs of iNKT-CARs disclosed herein, are given below in Tables 1-10. These include CD2, CD38, CD4, CD5, CD7, TRAC, TCRβ, BCMA, CS1, and CD38.

Fratricide Resistance. The CAR-T, INKT, NK and other CAR-bearing immune effector cells encompassed by the present disclosure are optionally deficient in one or more antigens to which the chimeric antigen receptor specifically binds and are therefore fratricide-resistant. In some embodiments, the one or more antigens of the cell is modified such the chimeric antigen receptor no longer specifically binds the one or more modified antigens. For example, the epitope of the one or more antigens recognized by the chimeric antigen receptor may be modified by one or more amino acid changes (e.g., substitutions or deletions) or the epitope may be deleted from the antigen. In other embodiments, expression of the one or more antigens is reduced in the cell by at least 50%, at least 60%, at least 70%, at least 80%, at least 90% or more. Methods for decreasing the expression of a protein are known in the art and include, but are not limited to, modifying or replacing the promoter operably linked to the nucleic acid sequence encoding the protein. In still other embodiments, the cell is modified such that the one or more antigens is not expressed, e.g., by deletion or disruption of the gene encoding the one or more antigens. In each of the above embodiments, the CAR-bearing immune effector cell may be deficient in one or preferably all the antigens to which the chimeric antigen receptor specifically binds. Methods for genetically modifying a cell to be deficient in one or more antigens are well known in art, and non-limiting examples are provided above. In an exemplary embodiment, CRISPR/cas9 gene editing can be used to modify a cell to be deficient in one or more antigens. Zinc finger nucleases (ZFNs) and transcription activator-like effector nucleases (TALENs) may also be used. See, e.g., Shearer RF and Saunders DN, "Experimental design for stable genetic manipulation in mammalian cell lines: lentivirus and alternatives," *Genes Cells* 2015 January;20 (1): 1-10.

Avoidance of Allogenicity. CAR-T, INKT, NK and other CAR-bearing immune effector cells encompassed by the present disclosure may further be deficient in endogenous T cell receptor (TCR) signaling as a result of deleting a part of the T Cell Receptor (TCR)-CD3 complex. In various embodiments it may be desirable to eliminate or suppress endogenous TCR signaling in CAR-bearing immune effector cells disclosed herein. For example, decreasing or eliminating endogenous TCR signaling in CAR-T cells may prevent or reduce graft versus host disease (GvHD) when allogenic T cells are used to produce the CAR-T cells. Methods for eliminating or suppressing endogenous TCR signaling are known in the art and include, but are not limited to, deleting a part of the TCR-CD3 receptor complex, e.g., the TCR receptor alpha chain (TRAC), the TCR receptor beta chain (TRBC), CD3ε CD3γ CD3δ, and/or CD3ζ. Deleting a part of the TCR receptor complex may block TCR mediated signaling and may thus permit the safe use of allogeneic T cells as the source of CAR-T cells without inducing life-threatening GvHD.

Suicide Genes. Alternatively, or in addition, CAR-bearing immune effector cells encompassed by the present disclosure may further comprise one or more suicide genes. As used herein, "suicide gene" refers to a nucleic acid sequence introduced to a cell by standard methods known in the art that, when activated, results in the death of the cell. Suicide genes may facilitate effective tracking and elimination of the CAR-bearing immune effector cells in vivo if required. Facilitated killing by activating the suicide gene may occur by methods known in the art. Suitable suicide gene therapy systems known in the art include, but are not limited to, various the herpes simplex virus thymidine kinase (HSVtk)/ganciclovir (GCV) suicide gene therapy systems or inducible caspase 9 protein. In an exemplary embodiment, a suicide gene is a CD34/thymidine kinase chimeric suicide gene.

Components that may be included in a CAR as described herein are provided below in Tables 1 and 2.

TABLE 1

Amino acid sequences of different CAR components.

| Functional domains | SEQ ID NO: | Amino acid sequence |
| --- | --- | --- |
| CD8α signal peptide | SEQ ID NO: 1 | MALPVTALLLPLALLLHAARP |
| CD8α hinge | SEQ ID NO: 2 | TTTPAPRPPTPAPTIASQPLSLRPEACR PAAGGAVHTRGLDFACD |
| CD28 Transmembrane ($T_m$) domain | SEQ ID NO: 3 | FWVLVVVGGVLACYSLLVTVAFIIFWV |
| Surface glycoprotein CD8 alpha chain isoform 1 precursor (NP_001139345.1) | SEQ ID NO: 4 | MALPVTALLLPLALLLHAARPSQFRVSPLDRT WNLGETVELKCQVLLSNPTSGCSWLFQPRGAA ASPTFLLYLSQNKPKAAEGLDTQRFSGKRLGDT FVLTLSDFRRENEGYYFCSALSNSIMYFSHFVP VFLPAKPTTTPAPRPPTPAPTIASQPLSLRPEACR PAAGGAVHTRGLDFACDIYIWAPLAGTCGVLL LSLVITLYCNHRNRRRVCKCPRPVVKSGDKPSL SARYV |
| 4-1BB costimulatory domain | SEQ ID NO: 5 | KRGRKKLLYIFKQPFMRPVQTTQEEDGCSCRFP EEEEGGCEL |
| CD28 costimulatory domain | SEQ ID NO: 6 | RSKRSRLLHSDYMNMTPRRPGPTRKHYQPYAP PRDFAAYRS |
| CD3 zeta (ζ) | SEQ ID NO: 7 | RVKFSRSADAPAYKQGQNQLYNELNLGRREEY DVLDKRRGRDPEMGGKPRRKNPQEGLYNELQ KDKMAEAYSEIGMKGERRRGKGHDGLYQGLS TATKDTYDALHMQALPPR |
| P2A peptide | SEQ ID NO: 8 | GSGATNFSLLKQAGDVEENPGP |
| (GGGGS)₄ linker | SEQ ID NO: 9 | GGGGSGGGGSGGGGSGGGGS |
| hCD34 | SEQ ID NO: 10 | MPRGWTALCLLSLLPSGFMSLDNNGTATPELP TQGTFSNVSTNVSYQETTTPSTLGSTSLHPVSQ HGNEATTNITETTVKFTSTSVITSVYGNTNSSVQ SQTSVISTVFTTPANVSTPETTLKPSLSPGNVSD LSTTSTSLATSPTKPYTSSSPILSDIKAEIKCSG IREVKLTQGICLEQNKTSSCAEFKKDRGEGLARV LCGEEQADADAGAQVCSLLLAQSEVRPQCLLL |

TABLE 1-continued

Amino acid sequences of different CAR components.

| Functional domains | SEQ ID NO: | Amino acid sequence |
|---|---|---|
| | | VLANRTEISSKLQLMKKHQSDLKKLGILDFTEQ DVASHQSYSQKTLIALVTSGALLAVLGITGYFL MNRRSWSPI |
| Human-Herpes Simplex Virus-1 (HSV)- thymidine kinase (TK) | SEQ ID NO: 11 | MPRGWTALCLLSLLPSGFMSLDNNGTATPELP TQGTFSNVSTNVSYQETTTPSTLGSTSLHPVSQ HGNEATTNITETTVKFTSTSVITSVYGNTNSSVQ SQTSVISTVFTTPANVSTPETTLKPSLSPGNVSD LSTTSTSLATSPTKPYTSSSPILSDIKAEIKCSG IREVKLTQGICLEQNKTSSCAEFKKDRGEGLARV LCGEEQADADAGAQVCSLLLAQSEVRPQCLLL VLANRTEISSKLQLMKKHQSDLKKLGILDFTEQ DVASHQSYSQKTLIALVTSGALLAVLGITGYFL MNRRSWSPTGEGGGGGDLGGVKLPHLFGKRL VEARMASYPCHQHASAFDQAARSRGHSNRRT ALRPRRQQEATEVRLEQKMPTLLRVYIDGPHG MGKTTTTQLLVALGSRDDIVYVPEPMTYWQV LGASETIANIYTTQHRLDQGEISAGDAAVVMTS AQITMGMPYAVTDAVLAPHVGGEAGSSHAPPP ALTLLLDRHPIAVMLCYPAARYLMGSMTPQAV LAFVALIPPTLPGTNIVLGALPEDRHIDRLAKRQ RPGERLDLAMLAAIRRVYGLLANTVRYLQGGG SWWEDWGQLSGTAVPPQGAEPQSNAGPRPHIG DTLFTLFRAPELLAPNGDLYNVFAWALDVLAK RLRPMHVFILDYDQSPAGCRDALLQLTSGMVQ THVTTPGSIPTICDLARTFAREMGEAN |

TABLE 2

Amino acid sequences of the variable heavy ($V_H$) and variable light ($V_L$) chains of the scFvs.

| ScFv sequences | SEQ ID NO: | Amino acid sequence |
|---|---|---|
| CD2 heavy chain variable region (35.1 ATCC®HB-222™) | SEQ ID NO: 12 | EVKLEESGAELVKPGASVKLSCRTSGFNIKDTI HWVKQRPEQGLKWIGRIDPANGNTKYDPKFQ DKATVTADTSSNTAYLQLSSLTSEDTAVYYCV TYAYDGNWYFDVWGAGTAVTVSS |
| CD2 light chain variable region (35.1 ATCC®HB-222™) | SEQ ID NO: 13 | DIKNITQSPSSMYVSLGERVTITCKASQDINSFL SWFQQKPGKSPKTLIYRANRLVDGVPSRFSGS GSGQDYSLTISSLEYEDMEIYYCLQYDEFPYTF GGGTKLEMKR |
| CD2 heavy chain variable region (OKT 11 ATCC®CRL-8027™) | SEQ ID NO: 14 | EVQLEESGAELVRPGTSVKLSCKASGYTFTSY WMHWIKQRPEQGLEWIGRIDPYDSETHYNEK FKDKAILSVDKSSSTAYIQLSSLTSDDSAVYYC SRRDAKYDGYALDYWGQGTSVTVSS |
| CD2 light chain variable region (OKT 11 ATCC®CRL-8027™) | SEQ ID NO: 15 | DIVMTQAAPSVPVTPGESVSISCRSSKTLLHSN GNTYLYWFLQRPGQSPQVLIYRMSNLASGVP NRFSGSGSETTFTLRISRVEAEDVGIYYCMQHL EYPYTFGGGTKLEIER |
| CD3 heavy chain variable region (OKT 3) | SEQ ID NO: 16 | GSQVQLQQSGAELARPGASVKMSCKASGYTF TRYTMHWVKQRPGQGLEWIGYINPSRGYTNY NQKFKDKATLTTDKSSSTAYMQLSSLTSEDSA VYYCARYYDDHYCLDYWGQGTTLTVSS |
| CD3 light chain variable region (OKT 3) | SEQ ID NO: 17 | QIVLTQSPAIMSASPGEKVTMTCSASSSVSYM NWYQQKSGTSPKRWIYDTSKLASGVPAHFRG SGSGTSYSLTISGMEAEDAATYYCQQWSSNPF TFGSGTKLEINR |
| CD3 heavy chain variable region (UCHT1) | SEQ ID NO: 18 | EVQLVESGGGLVQPGGSLRLSCAASGYSFTGY TMNWVRQAPGKCLEWVALINPYKGVSTYNQ KFKDRFTISVDKSKNTAYLQMNSLRAEDTAV YYCARSGYYGDSDWYFDVWGQGTLVTVSS |

TABLE 2-continued

Amino acid sequences of the variable heavy (V$_H$)
and variable light (V$_L$) chains of the scFvs.

| ScFv sequences | SEQ ID NO: | Amino acid sequence |
|---|---|---|
| CD3 heavy chain variable region (UCHT1) | SEQ ID NO: 19 | DIQMTQSPSSLSASVGDRVTITCRASQDIRNYL NWYQQKPGKAPKLLIYYTSRLESGVPSRFSGS GSGTDYTLTISSLQPEDFATYYCQQGNTLPWT FGCGTKVEIK |
| CD7 heavy chain variable region | SEQ ID NO: 20 | EVQLVESGGGLVKPGGSLKLSCAASGLTFSSY AMSWVRQTPEKRLEWVASISSGGFTYYPDSV KGRFTISRDNARNILYLQMSSLRSEDTAMYYC ARDEVRGYLDVWGAGTTVTVS |
| CD7 light chain variable region | SEQ ID NO: 21 | DIQMTQTTSSLSASLGDRVTISCSASQGISNYL NWYQQKPDGTVKLLIYYTSSLHSGVPSRFSGS GSGTDYSLTISNLEPEDIATYYCQQYSKLPYTF GGGTKLEIKR |
| FTL3 heavy chain variable region (EB10) | SEQ ID NO: 22 | EVQLVQSGAEVKKPGASVKVSCKASGYTFTS YYMHWVRQAPGQGLEWMGIINPSGGSTSYAQ KFQGRVTMTRDTSTSTVYMELSSLRSEDTAVY YCARGVGAHDAFDIWGQGTTVTVSS |
| FTL3 light chain variable region (EB10) | SEQ ID NO: 23 | DVVMTQSPLSLPVTPGEPASISCRSSQSLLHSN GNNYLDWYLQKPGQSPQLLIYLGSNRASGVP DRFSGSGSDTDFTLQISRVEAEDVGVYYCMQG THPAISFGQGTRLEIK |
| FTL3 heavy chain variable region (NC7) | SEQ ID NO: 24 | EVQLVQSGAEVKKPGSSVKVSCKASGGTFSSY AISWVRQAPGQGLEWMGGIIPIFGTANYAQKF QGRVTITADKSTSTAYMELSSLRSEDTAVYYC ATFALFGFREQAFDIWGQGTTVTVSS |
| FTL3 light chain variable region (NC7) | SEQ ID NO: 25 | DIQMTQSPSSLSASVGDRVTITCRASQSISSYLN WYQQKPGKAPKLLIYAASSLQSGVPSRFSGSG SGTDFTLTISSLQPEDLATYYCQQSYSTPFTFGP GTKVDIK |
| FTL3 heavy chain variable region (D3-D4) | SEQ ID NO: 26 | EVQLVQSGAEVKKPGASVKVSCKASGYTFTS YYMHWARQAPGQGLEWMGIINPSGGSTSYAQ KFQGRVTMTRDTSTSTVYMELSSLRSEDTAVY YCARVVAAAVADYWGQGTLVTVSS |
| FTL3 light chain variable region (D3-D4) | SEQ ID NO: 27 | DVVMTQSPLSLPVTPGEPASISCRSSQSLLHSN GYNYLDWYLQKPGQSPQLLIYLGSNRASGVP DRFSGSGSGTDFTLKISRVEAEDVGVYYCMQS LQTPFTFGPGTKVDIK |
| CS1 heavy chain variable region | SEQ ID NO: 28 | QVQLQQPGAELVRPGASVKLSCKASGYSFTTY WMNWVKQRPGQGLEWIGMIHPSDSETRL NQKFKDKATLTVDKSSSTAYMQLSSPTSEDSA VYYCARSTMIATRAMDYWGQGTSVTVSS |
| CS1 light chain variable region | SEQ ID NO: 29 | DIVMTQSQKSMSTSVGDRVSITCKASQDVITG VAWYQQKPGQSPKLLIYSASYRYTGVPD RFTGSGSGTDFTFTISNVQAEDLAVYYCQQHY STPLTFGAGTKLELK |
| CD33 heavy chain variable region | SEQ ID NO: 30 | QVQLQQPGAEVVKPGASVKMSCKASGYTFTS YYIHWIKQTPGQGLEWVGVIYPGNDDISYNQK FQGKATLTADKSSTTAYMQLSSLTSEDSAVYY CAREVRLRYFDVWGQGTTVTVSSSG |
| CD33 light chain variable region | SEQ ID NO: 31 | GSEIVLTQSPGSLAVSPGERVTMSCKSSQSVFF SSSQKNYLAWYQQIPGQSPRLLIYWASTRESG VPDRFTGSGSGTDFTLTISSVQPEDLAIYYCHQ YLSSRTFGQGTKLEIKR |

Mono CAR-T Cells

In certain embodiments, the disclosure provides an engineered T cell comprising a single CAR, that specifically binds an antigen or cell surface protein, wherein the T cell is optionally deficient in that antigen or cell surface protein (e.g., CD7CARTΔCD7 cell). In non-limiting examples, the deficiency in the antigen or cell surface protein resulted from (a) modification of antigen or cell surface protein expressed by the T cell such that the chimeric antigen receptors no longer specifically binds the modified antigen or cell surface protein (e.g., the epitope of the one or more antigens recognized by the chimeric antigen receptor may be modified by one or more amino acid changes (e.g., substitutions or deletions) or the epitope may be deleted from the antigen), (b) modification of the T cell such that expression of antigen or cell surface protein is reduced in the T cell by at least 50%, at least 60%, at least 70%, at least 80%, at least 90% or more, or (c) modification of the T cell such that antigen or cell surface protein is not expressed (e.g., by deletion or disruption of the gene encoding antigen or cell surface protein). In each of the above embodiments, the CAR-T cell may be deficient in one or preferably all the antigens or cell surface proteins to which the chimeric antigen receptor specifically binds. The methods to genetically modify a T cell to be deficient in one or more antigens or cell surface proteins are well known in art and non-limiting examples are provided herein. In embodiments described below, the CRISPR-Cas9 system is used to modify a T cell to be deficient in one or more antigens. Any of these may be accomplished by the methods disclosed herein. In further embodiments, the T cell comprises a suicide gene.

For example, the CAR for a CD7 specific CAR-T cell may be generated by cloning a commercially synthesized anti-CD7 single chain variable fragment (scFv) into a 3rd generation CAR backbone with CD28 and/or 4-1BB internal signaling domains. An extracellular hCD34 domain may be added after a P2A peptide to enable both detection of CAR following viral transduction and purification using anti-hCD34 magnetic beads. A similar method may be followed for making CARs specific for other malignant T cell antigens.

CAR-T cells encompassed by the present disclosure may further be deficient in endogenous T cell receptor (TCR) signaling as a result of deleting a part of the T Cell Receptor (TCR)-CD3 complex. In various embodiments it may be desirable to eliminate or suppress endogenous TCR signaling in CAR-T cells disclosed herein. For example, decreasing or eliminating endogenous TCR signaling in CAR-T cells may prevent or reduce graft versus host disease (GvHD) when allogenic T cells are used to produce the CAR-T cells. Methods for eliminating or suppressing endogenous TCR signaling are known in the art and include, but are not limited to, deleting a part of the TCR-CD3 receptor complex, e.g., the TCR receptor alpha chain (TRAC), the TCR receptor beta chain (TCRβ) or subtypes thereof, TCRδ, TCRγ, CD3ε, CD3γ, and/or CD3δ. Deleting a part of the TCR receptor complex may block TCR mediated signaling and may thus permit the safe use of allogeneic T cells as the source of CAR-T cells without inducing life-threatening GvHD.

In addition, the CAR-T cells encompassed by the present disclosure may further comprise one or more suicide genes as described herein.

In a similar manner, other mono-CAR-T cells may be constructed and are given below in Table 3.

TABLE 3

Mono CARs and CAR-Ts

| Example | Antigen Target of CAR-T cells | Antigen Deletion/Suppression |
|---|---|---|
| M1 | APRIL | — |
| M2 | APRIL | APRIL |
| M3 | APRIL | APRIL + TRAC |
| M4 | APRIL | APRIL + CD3ε |
| M5 | APRIL | CD3ε |
| M6 | BCMA | — |
| M7 | CD117 | — |
| M8 | CD117 | CD117 |
| M9 | CD123 | — |
| M10 | CD123 | CD123 |

TABLE 3-continued

Mono CARs and CAR-Ts

| Example | Antigen Target of CAR-T cells | Antigen Deletion/Suppression |
|---|---|---|
| M11 | CD135 | — |
| M12 | CD135 | CD135 |
| M13 | CD138 | — |
| M14 | CD19 | — |
| M15 | CD1a | — |
| M16 | CD1a | CD3ε |
| M17 | CD1a | TRAC |
| M18 | CD1a | CD1a + TRAC |
| M19 | CD1a | CD1a + CD3ε |
| M20 | CD2 | — |
| M21 | CD2 | CD2 |
| M22 | CD2 | CD2 + TRAC |
| M23 | CD2 | CD2 + CD3ε |
| M24 | CD20 | |
| M25 | CD21 | |
| M26 | CD22 | |
| M27 | CD23 | |
| M28 | CD3 | — |
| M29 | CD3 | CD3ε |
| M30 | CD3 | CD3ε + TRAC |
| M31 | CD33 | — |
| M32 | CD33 | CD33 |
| M33 | CD371 | — |
| M34 | CD371 | CD371 |
| M35 | CD38 | — |
| M36 | CD38 | CD38 |
| M37 | CD4 | — |
| M38 | CD4 | CD4 |
| M39 | CD4 | CD4 + TRAC |
| M40 | CD4 | CD4 + CD3ε |
| M41 | CD5 | — |
| M42 | CD5 | CD5 |
| M43 | CD5 | CD5 + TRAC |
| M44 | CD5 | CD5 + CD3ε |
| M45 | CD56 | — |
| M46 | CD56 | CD56 |
| M47 | CD56 | CD56 + TRAC |
| M48 | CD56 | CD56 + CD3ε |
| M49 | CD56 | CD3ε |
| M50 | CD56 | TRAC |
| M51 | CD7 | — |
| M52 | CD7 | CD7 |
| M53 | CD7 | CD7 + TRAC |
| M54 | CD7 | CD7 + CD3ε |
| M55 | CD79A | — |
| M56 | CD79B | — |
| M57 | CS1 | — |
| M58 | CS1 | CS1 |
| M59 | Tim-3 | — |
| M60 | Tim-3 | Tim-3 |
| M61 | Tim-3 | Tim-3 + TRAC |
| M62 | Tim-3 | TRAC |
| M63 | Tim-3 | CD3ε |
| M64 | Tim-3 | Tim-3 + CD3ε |

Disclosed are embodiments of CAR amino acid sequences that can be expressed on the surface of a genome-edited CAR-T cell derived from a cytotoxic T cell, a memory T cell, or a gamma delta (γδ) T cell.

TABLE 4

Amino Acid Sequences of Mono Chimeric Antigen Receptors (CARs).

| Mono CAR Constructs | SEQ ID NO: | Amino acid sequence |
|---|---|---|
| CD7-CAR-4-1BB_CD34 | SEQ ID NO: 32 | MALPVTALLLPLALLLHAARPDIQMTQTTSSLSASLGDRVT ISCSASQGISNYLNWYQQKPDGTVKLLIYYTSSLHSGVPSRF SGSGSGTDYSLTISNLEPEDIATYYCQQYSKLPYTFGGGTKL EIKRGGGGSGGGGSGGGGSGGGGSEVQLVESGGGLVKPG GSLKLSCAASGLTFSSYAMSWVRQTPEKRLEWVASISSGGF TYYPDSVKGRFTISRDNARNILYLQMSSLRSEDTAMYYCA RDEVRGYLDVWGAGTTVTVSPRASTTTPAPRPPTPAPTIAS QPLSLRPEACRPAAGGAVHTRGLDFACDFWVLVVVGGVL ACYSLLVTVAFIIFWVKRGRKKLLYIFKQPFMRPVQTTQEE DGCSCRFPEEEEGGCELRVKFSRSADAPAYKQGQNQLYNE LNLGRREEYDVLDKRRGRDPEMGGKPRRKNPQEGLYNEL QKDKMAEAYSEIGMKGERRRGKGHDGLYQGLSTATKDTY DALHMQALPPRRTDGSGATNFSLLKQAGDVEENPGPVSEA MPRGWTALCLLSLLPSGFMSLDNNGTATPELPTQGTFSNVS TNVSYQETTTPSTLGSTSLHPVSQHGNEATTNITETTVKFTS TSVITSVYGNTNSSVQSQTSVISTVFTTPANVSTPETTLKPSL SPGNVSDLSTTSTSLATSPTKPYTSSSPILSDIKAEIKCSGI REVKLTQGICLEQNKTSSCAEFKKDRGEGLARVLCGEEQADA DAGAQVCSLLLAQSEVRPQCLLLVLANRTEISSKLQLMKK HQSDLKKLGILDFTEQDVASHQSYSQKTLIALVTSGALLAV LGITGYFLMNRRSWSPI |
| CD7-CAR-4-1BB_CD34_TK | SEQ ID NO: 33 | MALPVTALLLPLALLLHAARPDIQMTQTTSSLSASLGDRVT ISCSASQGISNYLNWYQQKPDGTVKLLIYYTSSLHSGVPSRF SGSGSGTDYSLTISNLEPEDIATYYCQQYSKLPYTFGGGTKL EIKRGGGGSGGGGSGGGGSGGGGSEVQLVESGGGLVKPG GSLKLSCAASGLTFSSYAMSWVRQTPEKRLEWVASISSGGF TYYPDSVKGRFTISRDNARNILYLQMSSLRSEDTAMYYCA RDEVRGYLDVWGAGTTVTVSPRASTTTPAPRPPTPAPTIAS QPLSLRPEACRPAAGGAVHTRGLDFACDFWVLVVVGGVL ACYSLLVTVAFIIFWVKRGRKKLLYIFKQPFMRPVQTTQEE DGCSCRFPEEEEGGCELRVKFSRSADAPAYKQGQNQLYNE LNLGRREEYDVLDKRRGRDPEMGGKPRRKNPQEGLYNEL QKDKMAEAYSEIGMKGERRRGKGHDGLYQGLSTATKDTY DALHMQALPPRRTDGSGATNFSLLKQAGDVEENPGPVSEA MPRGWTALCLLSLLPSGFMSLDNNGTATPELPTQGTFSNVS TNVSYQETTTPSTLGSTSLHPVSQHGNEATTNITETTVKFTS TSVITSVYGNTNSSVQSQTSVISTVFTTPANVSTPETTLKPSL SPGNVSDLSTTSTSLATSPTKPYTSSSPILSDIKAEIKCSGIRE VKLTQGICLEQNKTSSCAEFKKDRGEGLARVLCGEEQADA DAGAQVCSLLLAQSEVRPQCLLLVLANRTEISSKLQLMKK HQSDLKKLGILDFTEQDVASHQSYSQKTLIALVTSGALLAV LGITGYFLMNRRSWSPTGEGGGGDLGGVKLPHLFGKRLV EARMASYPCHQHASAFDQAARSRGHSNRRTALRPRRQQE ATEVRLEQKMPTLLRVYIDGPHGMGKTTTTQLLVALGSRD DIVYVPEPMTYWQVLGASETIANIYTTQHRLDQGEISAGDA AVVMTSAQITMGMPYAVTDAVLAPHVGGEAGSSHAPPPA LTLLLLDRHPIAVMLCYPAARYLMGSMTPQAVLAFVALIPPT LPGTNIVLGALPEDRHIDRLAKRQRPGERLDLAMLAAIRRV YGLLANTVRYLQGGGSWWEDWGQLSGTAVPPQGAEPQS NAGPRPHIGDTLFTLFRAPELLAPNGDLYNVFAWALDVLA KRLRPMHVFILDYDQSPAGCRDALLQLTSGMVQTHVTTPG SIPTICDLARTFAREMGEAN |
| CD7-CAR-CD28_CD34 | SEQ ID NO: 34 | MALPVTALLLPLALLLHAARPDIQMTQTTSSLSASLGDRVT ISCSASQGISNYLNWYQQKPDGTVKLLIYYTSSLHSGVPSRF SGSGSGTDYSLTISNLEPEDIATYYCQQYSKLPYTFGGGTKL EIKRGGGGSGGGGSGGGGSGGGGSEVQLVESGGGLVKPG GSLKLSCAASGLTFSSYAMSWVRQTPEKRLEWVASISSGGF TYYPDSVKGRFTISRDNARNILYLQMSSLRSEDTAMYYCA RDEVRGYLDVWGAGTTVTVSPRASTTTPAPRPPTPAPTIAS QPLSLRPEACRPAAGGAVHTRGLDFACDFWVLVVVGGVL ACYSLLVTVAFIIFWVRSKRSRLLHSDYMNMTPRRPGPTRK HYQPYAPPRDFAAYRSRVKFSRSADAPAYKQGQNQLYNE LNLGRREEYDVLDKRRGRDPEMGGKPRRKNPQEGLYNEL QKDKMAEAYSEIGMKGERRRGKGHDGLYQGLSTATKDTY DALHMQALPPRRTDGSGATNFSLLKQAGDVEENPGPVSEA MPRGWTALCLLSLLPSGFMSLDNNGTATPELPTQGTFSNVS TNVSYQETTTPSTLGSTSLHPVSQHGNEATTNITETTVKFTS TSVITSVYGNTNSSVQSQTSVISTVFTTPANVSTPETTLKPSL SPGNVSDLSTTSTSLATSPTKPYTSSSPILSDIKAEIKCSGIRE VKLTQGICLEQNKTSSCAEFKKDRGEGLARVLCGEEQADA DAGAQVCSLLLAQSEVRPQCLLLVLANRTEISSKLQLMKK HQSDLKKLGILDFTEQDVASHQSYSQKTLIALVTSGALLAV LGITGYFLMNRRSWSPI |

TABLE 4-continued

Amino Acid Sequences of Mono Chimeric Antigen Receptors (CARs).

| Mono CAR Constructs | SEQ ID NO: | Amino acid sequence |
|---|---|---|
| CD7-CAR-CD28_CD34_TK | SEQ ID NO: 35 | MALPVTALLLPLALLLHAARPDIQMTQTTSSLSASLGDRVT ISCSASQGISNYLNWYQQKPDGTVKLLIYYTSSLHSGVPSRF SGSGSGTDYSLTISNLEPEDIATYYCQQYSKLPYTFGGGTKL EIKRGGGGSGGGGSGGGGSGGGGSEVQLVESGGGLVKPG GSLKLSCAASGLTFSSYAMSWVRQTPEKRLEWVASISSGGF TYYPDSVKGRFTISRDNARNILYLQMSSLRSEDTAMYYCA RDEVRGYLDVWGAGTTVTVSPRASTTTPAPRPPTPAPTIAS QPLSLRPEACRPAAGGAVHTRGLDFACDFWVLVVVGGVL ACYSLLVTVAFIIFWVRSKRSRLLHSDYMNMTPRRPGPTRK HYQPYAPPRDFAAYRSRVKFSRSADAPAYKQGQNQLYNE LNLGRREEYDVLDKRRGRDPEMGGKPRRKNPQEGLYNEL QKDKMAEAYSEIGMKGERRRGKGHDGLYQGLSTATKDTY DALHMQALPPRRTDGSGATNFSLLKQAGDVEENPGPVSEA MPRGWTALCLLSLLPSGFMSLDNNGTATPELPTQGTFSNVS TNVSYQETTTPSTLGSTSLHPVSQHGNEATTNITETTVKFTS TSVITSVYGNTNSSVQSQTSVISTVFTTPANVSTPETTLKPSL SPGNVSDLSTTSTSLATSPTKPYTSSSPILSDIKAEIKCSGIRE VKLTQGICLEQNKTSSCAEFKKDRGEGLARVLCGEEQADA DAGAQVCSLLLAQSEVRPQCLLLVLANRTEISSKLQLMKK HQSDLKKLGILDFTEQDVASHQSYSQKTLIALVTSGALLAV LGITGYFLMNRRSWSPTGEGGGGDLGGVKLPHLFGKRLV EARMASYPCHQHASAFDQAARSRGHSNRRTALRPRRQQE ATEVRLEQKMPTLLRVYIDGPHGMGKTTTTQLLVALGSRD DIVYVPEPMTYWQVLGASETIANIYTTQHRLDQGEISAGDA AVVMTSAQITMGMPYAVTDAVLAPHVGGEAGSSHAPPPA LTLLLDRHPIAVMLCYPAARYLMGSMTPQAVLAFVALIPPT LPGTNIVLGALPEDRHIDRLAKRQRPGERLDLAMLAAIRRV YGLLANTVRYLQGGGSWWEDWGQLSGTAVPPQGAEPQS NAGPRPHIGDTLFTLFRAPELLAPNGDLYNVFAWALDVLA KRLRPMHVFILDYDQSPAGCRDALLQLTSGMVQTHVTTPG SIPTICDLARTFAREMGEAN |
| CD79B-CAR-CD28_CD34 | SEQ ID NO: 36 | MALPVTALLLPLALLLHAARPGSDIQLTQSPSSLSASVGDR VTITCKASQSVDYEGDSFLNWYQQKPGKAPKLLIYAASNL ESGVPSRFSGSGSGTDFTLTISSLQPEDFATYYCQQSNEDPL TFGQGTKVEIKRGGGGSGGGGSGGGGSGGGGSGGGGSEV QLVESGGGLVQPGGSLRLSCAASGYTFSSYWIEWVRQAPG KGLEWIGEILPGGGDTNYNEIFKGRATFSADTSKNTAYLQM NSLRAEDTAVYYCTRRVPIRLDYWGQGTLVTVSSPRASTT TPAPRPPTPAPTIASQPLSLRPEACRPAAGGAVHTRGLDFAC DFWVLVVVGGVLACYSLLVTVAFIIFWVRSKRSRLLHSDY MNMTPRRPGPTRKHYQPYAPPRDFAAYRSRVKFSRSADAP AYKQGQNQLYNELNLGRREEYDVLDKRRGRDPEMGGKPR RKNPQEGLYNELQKDKMAEAYSEIGMKGERRRGKGHDGL YQGLSTATKDTYDALHMQALPPRRTDGSGATNFSLLKQAG DVEENPGPVSEAMPRGWTALCLLSLLPSGFMSLDNNGTAT PELPTQGTFSNVSTNVSYQETTTPSTLGSTSLHPVSQHGNEA TTNITETTVKFTSTSVITSVYGNTNSSVQSQTSVISTVFTTPA NVSTPETTLKPSLSPGNVSDLSTTSTSLATSPTKPYTSSSPILS DIKAEIKCSGIREVKLTQGICLEQNKTSSCAEFKKDRGEGLA RVLCGEEQADADAGAQVCSLLLAQSEVRPQCLLLVLANRT EISSKLQLMKKHQSDLKKLGILDFTEQDVASHQSYSQKTLI ALVTSGALLAVLGITGYFLMNRRSWSPTGEGGGGGFKRDL GGVKLPHLFGKRLVEARMASYPCHQHASAFDQAARSRGH SNRRTALRPRRQQEATEVRLEQKMPTLLRVYIDGPHGMGK TTTTQLLVALGSRDDIVYVPEPMTYWQVLGASETIANIYTT QHRLDQGEISAGDAAVVMTSAQITMGMPYAVTDAVLAPH VGGEAGSSHAPPPALTLLLDRHPIAVMLCYPAARYLMGSM TPQAVLAFVALIPPTLPGTNIVLGALPEDRHIDRLAKRQRPG ERLDLAMLAAIRRVYGLLANTVRYLQGGGSWWEDWGQL SGTAVPPQGAEPQSNAGPRPHIGDTLFTLFRAPELLAPNGD LYNVFAWALDVLAKRLRPMHVFILDYDQSPAGCRDALLQ LTSGMVQTHVTTPGSIPTICDLARTFAREMGEAN |
| CD2-CAR-CD28_CD34 | SEQ ID NO: 37 | MALPVTALLLPLALLLHAARPDIVMTQAAPSVPVTPGESVS ISCRSSKTLLHSNGNTYLYWFLQRPGQSPQVLIYRMSNLAS GVPNRFSGSGSETTFTLRISRVEAEDVGIYYCMQHLEYPYT FGGGTKLEIERGGGGSGGGGSGGGGSGGGGSEVQLEESGA ELVRPGTSVKLSCKASGYTFTSYWMHWIKQRPEQGLEWIG RIDPYDSETHYNEKFKDKAILSVDKSSSTAYIQLSSLTSDDS AVYYCSRRDAKYDGYALDYWGQGTSVTVSSPRASTTTPA PRPPTPAPTIASQPLSLRPEACRPAAGGAVHTRGLDFACDF WVLVVVGGVLACYSLLVTVAFIIFWVRSKRSRLLHSDYMN MTPRRPGPTRKHYQPYAPPRDFAAYRSRVKFSRSADAPAY |

TABLE 4-continued

Amino Acid Sequences of Mono Chimeric Antigen Receptors (CARs).

| Mono CAR Constructs | SEQ ID NO: | Amino acid sequence |
|---|---|---|
| | | KQGQNQLYNELNLGRREEYDVLDKRRGRDPEMGGKPRRK<br>NPQEGLYNELQKDKMAEAYSEIGMKGERRRGKGHDGLYQ<br>GLSTATKDTYDALHMQALPPRRTDGSGATNFSLLKQAGDV<br>EENPGPVSEAMPRGWTALCLLSLLPSGFMSLDNNGTATPEL<br>PTQGTFSNVSTNVSYQETTTPSTLGSTSLHPVSQHGNEATT<br>NITETTVKFTSTSVITSVYGNTNSSVQSQTSVISTVFTTPANV<br>STPETTLKPSLSPGNVSDLSTTSTSLATSPTKPYTSSSPILSDI<br>KAEIKCSGIREVKLTQGICLEQNKTSSCAEFKKDRGEGLAR<br>VLCGEEQADADAGAQVCSLLLAQSEVRPQCLLLVLANRTE<br>ISSKLQLMKKHQSDLKKLGILDFTEQDVASHQSYSQKTLIA<br>LVTSGALLAVLGITGYFLMNRRSWSPI |
| CD2-CAR-4-1BB_CD34 | SEQ ID NO: 38 | MALPVTALLLPLALLLHAARPDIVMTQAAPSVPVTPGESVS<br>ISCRSSKTLLHSNGNTYLYWFLQRPGQSPQVLIYRMSNLAS<br>GVPNRFSGSGSETTFTLRISRVEAEDVGIYYCMQHLEYPYT<br>FGGGTKLEIERGGGGSGGGGSGGGGSGGGGSEVQLEESGA<br>ELVRPGTSVKLSCKASGYTFTSYWMHWIKQRPEQGLEWIG<br>RIDPYDSETHYNEKFKDKAILSVDKSSSTAYIQLSSLTSDDS<br>AVYYCSRRDAKYDGYALDYWGQGTSVTVSSPRASTTTPA<br>PRPPTPAPTIASQPLSLRPEACRPAAGGAVHTRGLDFACDF<br>WVLVVVGGVLACYSLLVTVAFIIFWVKRGRKKLLYIFKQP<br>FMRPVQTTQEEDGCSCRFPEEEEGGCELRVKFSRSADAPAY<br>KQGQNQLYNELNLGRREEYDVLDKRRGRDPEMGGKPRRK<br>NPQEGLYNELQKDKMAEAYSEIGMKGERRRGKGHDGLYQ<br>GLSTATKDTYDALHMQALPPRRTDGSGATNFSLLKQAGDV<br>EENPGPVSEAMPRGWTALCLLSLLPSGFMSLDNNGTATPEL<br>PTQGTFSNVSTNVSYQETTTPSTLGSTSLHPVSQHGNEATT<br>NITETTVKFTSTSVITSVYGNTNSSVQSQTSVISTVFTTPANV<br>STPETTLKPSLSPGNVSDLSTTSTSLATSPTKPYTSSSPILSDI<br>KAEIKCSGIREVKLTQGICLEQNKTSSCAEFKKDRGEGLAR<br>VLCGEEQADADAGAQVCSLLLAQSEVRPQCLLLVLANRTE<br>ISSKLQLMKKHQSDLKKLGILDFTEQDVASHQSYSQKTLIA<br>LVTSGALLAVLGITGYFLMNRRSWSPI |
| CD3-CD28-CD34 | SEQ ID NO: 39 | MALPVTALLLPLALLLHAARPGSQVQLQQSGAELARPGAS<br>VKMSCKASGYTFTRYTMHWVKQRPGQGLEWIGYINPSRG<br>YTNYNQKFKDKATLTTDKSSSTAYMQLSSLTSEDSAVYYC<br>ARYYDDHYCLDYWGQGTTLTVSSGGGGSGGGGSGGGGS<br>GGGGSQIVLTQSPAIMSASPGEKVTMTCSASSSVSYMNWY<br>QQKSGTSPKRWIYDTSKLASGVPAHFRGSGSGTSYSLTISG<br>MEAEDAATYYCQQWSSNPFTFGSGTKLEINRPRASTTTPAP<br>RPPPTPAPTIASQPLSLRPEACRPAAGGAVHTRGLDFACDFW<br>VLVVVGGVLACYSLLVTVAFIIFWVRSKRSRLLHSDYMNM<br>TPRRPGPTRKHYQPYAPPRDFAAYRSRVKFSRSADAPAYK<br>QGQNQLYNELNLGRREEYDVLDKRRGRDPEMGGKPRRKN<br>PQEGLYNELQKDKMAEAYSEIGMKGERRRGKGHDGLYQG<br>LSTATKDTYDALHMQALPPRRTDGSGATNFSLLKQAGDVE<br>ENPGPVSEAMPRGWTALCLLSLLPSGFMSLDNNGTATPELP<br>TQGTFSNVSTNVSYQETTTPSTLGSTSLHPVSQHGNEATTNI<br>TETTVKFTSTSVITSVYGNTNSSVQSQTSVISTVFTTPANVST<br>PETTLKPSLSPGNVSDLSTTSTSLATSPTKPYTSSSPILSDI<br>KAEIKCSGIREVKLTQGICLEQNKTSSCAEFKKDRGEGLARVL<br>CGEEQADADAGAQVCSLLLAQSEVRPQCLLLVLANRTEISS<br>KLQLMKKHQSDLKKLGILDFTEQDVASHQSYSQKTLIALV<br>TSGALLAVLGITGYFLMNRRSWSPI |

Tandem CAR-T Cells

A tandem CAR-T cell (tCAR-T), is a T cell with a single chimeric antigen polypeptide comprising two distinct extracellular ligand-binding (antigen/protein recognition) domains capable of interacting with two different cell surface molecules (e.g., antigen/protein), wherein the extracellular ligand-binding domains are linked together by one or more flexible linkers and share one or more costimulatory domains, wherein the binding of the first or second extracellular ligand-binding domain will signal through one or more the costimulatory domains(s) and a signaling transducing domain.

In certain embodiments, the T cell is deficient in one or more antigens or cell surface proteins (e.g., CD7 and CD2 for a CD7*CD2-tCARΔCD7ΔCD2 cell, or CD2 for a CD3*CD2-tCARΔCD3ΔCD2 cell). In non-limiting examples, the deficiency in the antigen(s) or cell surface protein(s) resulted from (a) modification of antigen or cell surface protein expressed by the T cell such that the chimeric antigen receptor no longer specifically binds the modified antigen(s) or cell surface protein(s) (e.g., the epitope of the one or more antigens recognized by the chimeric antigen receptor may be modified by one or more amino acid changes (e.g., substitutions or deletions) or the epitope may be deleted from the antigen), (b) modification of the T cell such that expression of antigen(s) or cell surface protein(s) is/are reduced in the T cell by at least 50%, at least 60%, at least 70%, at least 80%, at least 90% or more, or (c) modification of the T cell such that antigen(s) or cell surface protein(s) is/are not expressed (e.g., by deletion or disruption of the gene encoding antigen or cell surface protein). In each of the above embodiments, the CAR-T cell may be deficient in one or preferably all the antigens or cell surface proteins to which the chimeric antigen receptor specifically binds. The methods to genetically modify a T cell to be deficient in one or more antigens or cell surface proteins are well known in art and non-limiting examples are provided herein. In embodiments described below, the CRISPR-Cas9 system is used to modify a T cell to be deficient in one or more antigen(s) or cell surface protein(s). Any of these may be accomplished by the methods disclosed herein. In further embodiments, the T cell comprises a suicide gene.

A tCAR for a genome-edited, tandem CAR-T cell, i.e., CD2*CD3-tCARTΔCD2ΔCD38, may be generated by cloning a commercially synthesized anti-CD2 single chain variable fragment (scFv) and an anti-CD3 single chain variable fragment (scFv), separated by a peptide linker, into a lentiviral vector containing, e.g., a $2^{nd}$ or $3^{rd}$ generation CAR backbone with CD28 and/or 4-1BB internal signaling domains. An extracellular hCD34 domain may be added after a P2A peptide to enable both detection of CAR following viral transduction and purification using anti-hCD34 magnetic beads. A similar method may be followed for making tCARs specific for other malignant T cell antigens.

Tandem CARs may have different linker structures, i.e., be linear or hairpin, and the hairpin linker may optionally comprise a (Cys=Cys) double-stranded bond (DSB).

A linear tandem CAR-T cell comprises a chimeric antigen receptor (CAR) polypeptide comprising a first signal peptide, a first extracellular ligand-binding domain, a second extracellular ligand-binding domain, a hinge region, a transmembrane domain, one or more co-stimulatory domains, and a signaling transducing domain, wherein the first extracellular ligand-binding antigen recognition domain and the second extracellular ligand-binding antigen recognition domain have affinities for different cell surface molecules, i.e., antigens on a cancer cell, for example, a malignant T cell, B cell, or plasma cell; and wherein the linear tandem CAR-T cell possesses one or more genetic modifications, deletions, or disruptions resulting in reduced expression of the cell surface molecules in the linear tandem CAR-T cell.

In another embodiment, the signal peptide is the signal peptide from human CD8a.

In a third embodiment, the first extracellular ligand-binding domain comprises a single chain antibody fragment (scFv), comprising the light ($V_L$) and the heavy ($V_H$) variable fragment, designated $V_H1$ and $V_L1$ and joined by a linker (e.g., GGGGS (SEQ ID NO: 3065)). In some embodiments, this linker peptide is repeated 2, 3, 4, 5 or 6 times. In some embodiments, the first antigen recognition domain can be selected from: 1) $V_H1$-(GGGGS)$_{3-4}$ (SEQ ID NO: 3066)-$V_L1$ or 2) $V_L1$-(GGGGS)$_{3-4}$ (SEQ ID NO: 3066)-$V_H1$.

In some embodiments, the second extracellular ligand-binding domain comprises a single chain antibody fragment (scFv), comprising the light ($V_L$) and the heavy ($V_H$) variable fragment, designated $V_H2$ and $V_L2$ and joined by a linker (e.g., GGGGS (SEQ ID NO: 3065)). In some embodiments, this linker peptide is repeated 2, 3, 4, 5 or 6 times. In some embodiments, the first antigen recognition domain can be selected from: 1) $V_H2$-(GGGGS)$_{3-4}$ (SEQ ID NO: 3066)-$V_L2$ or 2) $V_L2$-(GGGGS)$_{3-4}$ (SEQ ID NO: 3066)-$V_H2$.

In further embodiments, the first antigen recognition domain and second antigen recognition domain are connected by a short linker peptide of 5 amino acids (GGGGS (SEQ ID NO: 3065)). In some embodiments, this linker peptide is repeated 2, 3, 4, 5, or 6 times.

Tandem CAR Constructs

In one embodiment, the first extracellular ligand-binding domain antigen recognition comprises a single chain antibody fragment (scFv), comprising the heavy ($V_H$) and the light ($V_L$) variable fragment, designated $V_H1$ and $V_L1$, and joined by a linker (e.g., GGGGS (SEQ ID NO: 3065)), targets a cell surface molecule, i.e., an antigen expressed on a malignant cell.

In certain embodiments, the heavy ($V_H$) and the light ($V_L$) variable fragment, designated $V_H1$ and $V_L1$, targeting an antigen expressed on a malignant T cell is selected from BCMA, CS1, CD38, CD138, CD19, CD33, CD123, CD371, CD117, CD135, Tim-3, CD5, CD7, CD2, CD4, CD3, CD79A, CD79B, APRIL, CD56, and CD1a.

In certain embodiments, the second extracellular ligand-binding domain antigen recognition comprises a single chain antibody fragment (scFv), comprising the heavy ($V_H$) and the light ($V_L$) variable fragment, designated $V_H2$ and $V_L2$, and joined by a linker (e.g., GGGGS (SEQ ID NO: 3065)), and targets a cell surface molecule, i.e., an antigen, expressed on a malignant cell.

In certain embodiments, the heavy ($V_H$) and the light ($V_L$) variable fragments, designated $V_H2$ and $V_L2$, targeting an antigen expressed on a malignant T cell is selected from BCMA, CS1, CD38, CD138, CD19, CD33, CD123, CD371, CD117, CD135, Tim-3, CD5, CD7, CD2, CD4, CD3, CD79A, CD79B, APRIL, CD56, and CD1a and differs from the variable heavy ($V_H1$) and light sequences ($V_L1$) of the first extracellular ligand-binding domain of the CAR molecule.

Additional examples of tandem CARs are given below in Table 5.

TABLE 5

Tandem CARs and CAR-Ts

| Example | Antigen Target CAR-T cell | Antigen Deletion/Suppression |
| --- | --- | --- |
| T1 | APRILxBCMA | — |
| T2 | APRILxCD19 | — |
| T3 | APRILxCD38 | — |
| T4 | APRILxCD38 | CD38 |
| T5 | APRILxCS1 | — |
| T6 | APRILxCS1 | CS1 |
| T7 | BCMAxCD19 | — |
| T8 | BCMAxCD38 | — |
| T9 | BCMAxCD38 | CD38 |
| T10 | BCMAxCS1 | — |
| T11 | BCMAxCS1 | CS1 |
| T12 | CD138xAPRIL | |
| T13 | CD138xBCMA | |
| T14 | CD138xCD19 | |
| T15 | CD138xCD38 | |
| T16 | CD138xCD38 | CD38 |
| T17 | CD138xCD79A | |
| T18 | CD138xCD79B | |
| T19 | CD138xCS1 | |
| T20 | CD138xCS1 | CS1 |
| T21 | CD19xCD38 | — |
| T22 | CD19xCD38 | CD38 |
| T23 | CD2xCD3ε | — |
| T24 | CD2xCD3ε | CD2 |
| T25 | CD2xCD3ε | CDε |
| T26 | CD2xCD3ε | CD2 and CD3ε |
| T27 | CD2xCD4 | — |
| T28 | CD2xCD4 | CD2 |
| T29 | CD2xCD4 | CD4 |
| T30 | CD2xCD4 | CD2 and CD4 |
| T31 | CD2xCD4 | CD2 and TRAC |
| T32 | CD2xCD4 | CD4 and TRAC |
| T33 | CD2xCD4 | CD2 and CD4 and TRAC |
| T34 | CD2xCD5 | — |
| T35 | CD2xCD5 | CD2 |

TABLE 5-continued

Tandem CARs and CAR-Ts

| Example | Antigen Target CAR-T cell | Antigen Deletion/Suppression |
|---|---|---|
| T36 | CD2xCD5 | CD5 |
| T37 | CD2xCD5 | CD2 and CD5 |
| T38 | CD2xCD5 | CD2 and TRAC |
| T39 | CD2xCD5 | CD5 and TRAC |
| T40 | CD2xCD5 | CD2 and CD5 and TRAC |
| T41 | CD2xCD7 | — |
| T42 | CD2xCD7 | CD2 |
| T43 | CD2xCD7 | CD7 |
| T44 | CD2xCD7 | CD2 and CD7 |
| T45 | CD2xCD7 | CD2 and TRAC |
| T46 | CD2xCD7 | CD7 and TRAC |
| T47 | CD2xCD7 | CD2 and CD7 and TRAC |
| T48 | CD3εxCD4 | — |
| T49 | CD3εxCD4 | CD3ε |
| T50 | CD3εxCD4 | CD4 |
| T51 | CD3εxCD4 | CD3ε and CD4 |
| T52 | CD3εxCD5 | — |
| T53 | CD3εxCD5 | CD3ε |
| T54 | CD3εxCD5 | CD5 |
| T55 | CD3εxCD5 | CD3ε and CD5 |
| T56 | CD3εxCD7 | — |
| T57 | CD3εxCD7 | CD3ε |
| T58 | CD3εxCD7 | CD7 |
| T59 | CD3εxCD7 | CD3ε and CD7 |
| T60 | CD4xCD5 | — |
| T61 | CD4xCD5 | CD4 |
| T62 | CD4xCD5 | CD5 |
| T63 | CD4xCD5 | CD4 and CD5 |
| T64 | CD4xCD5 | CD4 and TRAC |
| T65 | CD4xCD5 | CD5 and TRAC |
| T66 | CD4xCD5 | CD4 and CD5 and TRAC |
| T67 | CD4xCD7 | — |
| T68 | CD4xCD7 | CD4 |
| T69 | CD4xCD7 | CD7 |
| T70 | CD4xCD7 | CD4 and CD7 |
| T71 | CD4xCD7 | CD4 and TRAC |
| T72 | CD4xCD7 | CD4 and TRAC |
| T73 | CD4xCD7 | CD4 and CD7 and TRAC |
| T74 | CD5xCD7 | — |
| T75 | CD5xCD7 | CD5 |
| T76 | CD5xCD7 | CD7 |
| T77 | CD5xCD7 | CD5 and CD7 |
| T78 | CD5xCD7 | CD5 and TRAC |
| T79 | CD5xCD7 | CD7 and TRAC |
| T80 | CD5xCD7 | CD5 and CD7 and TRAC |
| T81 | CD79AxAPRIL | |
| T82 | CD79AxBCMA | |
| T83 | CD79AxCD19 | |
| T84 | CD79AxCD38 | |
| T85 | CD79AxCD38 | CD38 |
| T86 | CD79AxCD79B | |
| T87 | CD79AxCS1 | |
| T88 | CD79AxCS1 | CS1 |
| T89 | CD79BxAPRIL | |
| T90 | CD79BxBCMA | |
| T91 | CD79BxCD19 | |
| T92 | CD79BxCD38 | |
| T93 | CD79BxCD38 | CD38 |
| T94 | CD79BxCD79A | |
| T95 | CD79BxCS1 | |
| T96 | CD79BxCS1 | CS1 |
| T97 | CS1xCD19 | — |
| T98 | CS1xCD19 | CS1 |
| T99 | CS1xCD38 | — |
| T100 | CS1xCD38 | CS1 |
| T101 | CS1xCD38 | CD38 |
| T102 | CS1xCD38 | CS1 and CD38 |
| T103 | TCRβxCD2 | — |
| T104 | TCRβxCD2 | TCRβ |
| T105 | TCRβxCD2 | CD2 |
| T106 | TCRβxCD2 | TCRβ and CD2 |
| T107 | TCRβxCD3ε | — |
| T108 | TCRβxCD3ε | TCRβ |
| T109 | TCRβxCD3ε | CD3ε |
| T110 | TCRβxCD3ε | TCRβ and CD3ε |
| T111 | TCRβxCD4 | — |
| T112 | TCRβxCD4 | TCRβ |
| T113 | TCRβxCD4 | CD4 |
| T114 | TCRβxCD4 | TCRβ and CD4 |
| T115 | TCRβxCD5 | — |
| T116 | TCRβxCD5 | TCRβ |
| T117 | TCRβxCD5 | CD5 |
| T118 | TCRβxCD5 | TCRβ and CD5 |
| T119 | TCRβxCD7 | — |
| T120 | TCRβxCD7 | TCRβ |
| T121 | TCRβxCD7 | CD7 |
| T122 | TCRβxCD7 | TCRβ and CD7 |
| T123 | TRACxCD2 | — |
| T124 | TRACxCD2 | TRAC |
| T125 | TRACxCD2 | CD2 |
| T126 | TRACxCD2 | TRAC and CD2 |
| T127 | TRACxCD3ε | — |
| T128 | TRACxCD3ε | TRAC |
| T129 | TRACxCD3ε | CD3ε |
| T130 | TRACxCD3ε | TRAC and CD3ε |
| T131 | TRACxCD4 | — |
| T132 | TRACxCD4 | TRAC |
| T133 | TRACxCD4 | CD4 |
| T134 | TRACxCD4 | TRAC and CD4 |
| T135 | TRACxCD5 | — |
| T136 | TRACxCD5 | TRAC |
| T137 | TRACxCD5 | CD5 |
| T138 | TRACxCD5 | TRAC and CD5 |
| T139 | TRACxCD7 | — |
| T140 | TRACxCD7 | TRAC |
| T141 | TRACxCD7 | CD7 |
| T142 | TRACxCD7 | TRAC and CD7 |

In some embodiments, hairpin tandem CAR constructs may be provided herein, such as including, but not limited to, a construct incorporating the $V_H$ and $V_L$ domains of CD2 and CD3 scFvs (Table 6).

TABLE 6

Hairpin Tandem CAR Constructs Targeting CD2 and CD3.

| Clone 5 | Clone 6 | Clone 7 | Clone 8 | Clone 13 | Clone 14 | Clone 15 | Clone 16 |
|---|---|---|---|---|---|---|---|
| CD8a | CD8a | CD8a | CD8a | CD8a | CD8a | CD8a | CD8a |
| CD3-$V_L$ | CD3-$V_L$ | CD3-$V_L$ | CD3-$V_L$ | CD2-$V_L$ | CD2-$V_L$ | CD3-$V_L$ | CD3-$V_L$ |
| GGGGS$_4$ (SEQ ID NO: 9) | GGGGS$_4$ (SEQ ID NO: 9) | GGGGS$_4$ (SEQ ID NO: 9) | GGGGS$_4$ (SEQ ID NO: 9) | GGGGS$_4$ (SEQ ID NO: 9) | GGGGS$_4$ (SEQ ID NO: 9) | GGGGS$_4$ (SEQ ID NO: 9) | GGGGS$_4$ (SEQ ID NO: 9) |

TABLE 6-continued

Hairpin Tandem CAR Constructs Targeting CD2 and CD3.

| CD2-$V_L$ | CD2-$V_L$ | CD2-$V_L$ | CD2-$V_L$ | CD3-$V_L$ | CD3-$V_L$ | CD2-$V_L$ | CD2-$V_L$ |
|---|---|---|---|---|---|---|---|
| (GGGGS)$_{10}$ (SEQ ID NO: 3067) | (GGGGS)$_4$ GGGGP(GGGGS)$_4$ (SEQ ID NO: 3068) | (GGGGS)$_{10}$ (SEQ ID NO: 3067) | (GGGGS)$_4$ GGGGP(GGGGS)$_4$ (SEQ ID NO: 3068) | (GGGGS)$_{10}$ (SEQ ID NO: 3067) | (GGGGS)$_4$ GGGGP(GGGS)$_4$ (SEQ ID NO: 3068) | (GGGGS)$_{10}$ (SEQ ID NO: 3067) | (GGGGS)$_4$ GGGGP(GGGS)$_4$ (SEQ ID NO: 3068) |
| CD2-$V_H$ | CD2-$V_H$ | CD2-$V_H$ | CD2-$V_H$ | CD3-$V_H$ | CD3-$V_H$ | CD2-$V_H$ | CD2-$V_H$ |
| GGGGS$_4$ (SEQ ID NO: 9) | GGGGS$_4$ (SEQ ID NO: 9) | GGGGS$_4$ (SEQ ID NO: 9) | GGGGS$_4$ (SEQ ID NO: 9) | GGGGS$_4$ (SEQ ID NO: 9) | GGGGS$_4$ (SEQ ID NO: 9) | GGGGS$_4$ (SEQ ID NO: 9) | GGGGS$_4$ (SEQ ID NO: 9) |
| CD3-$V_H$ | CD3-$V_H$ | CD3-$V_H$ | CD3-$V_H$ | CD2-$V_H$ | CD2-$V_H$ | CD3-$V_H$ | CD3-$V_H$ |
| CD28 Tm CD28 CD3z$_{(1-2)}$ P2A CD34 | CD28 Tm CD28 CD3z$_{(1-2)}$ P2A CD34 | CD28 Tm CD28 CD3z$_{(1-2)}$ P2A CD34 | CD28 Tm CD28 CD3z$_{(1-2)}$ P2A CD34 | CD28 Tm CD28 CD3z$_{(1-2)}$ P2A CD34 | CD28 Tm CD28 CD3z$_{(1-2)}$ P2A CD34 | CD28 Tm CD28 CD3z$_{(1-2)}$ P2A CD34 | CD28 Tm CD28 CD3z$_{(1-2)}$ P2A CD34 |

Dual CAR-T Cells

In certain embodiments, the disclosure provides an engineered T cell with two distinct chimeric antigen receptor polypeptides with affinity to different antigen(s) or cell surface protein(s) expressed within the same effector cell, wherein each CAR functions independently. The CAR may be expressed from single or multiple polynucleotide sequences that specifically bind different antigen(s) or cell surface protein(s), wherein the T cell is deficient in the antigen(s) or cell surface protein(s) to which the CARs bind (e.g., CD7*CD2-dCARΔCD7ΔCD2 cell). In non-limiting examples, the deficiency in the antigen(s) or cell surface protein(s) resulted from (a) modification of antigen or cell surface protein expressed by the T cell such that the chimeric antigen receptor no longer specifically binds the modified antigen(s) or cell surface protein(s) (e.g., the epitope of the one or more antigens recognized by the chimeric antigen receptor may be modified by one or more amino acid changes (e.g., substitutions or deletions) or the epitope may be deleted from the antigen), (b) modification of the T cell such that expression of antigen(s) or cell surface protein(s) is/are reduced in the T cell by at least 50%, at least 60%, at least 70%, at least 80%, at least 90% or more, or (c) modification of the T cell such that antigen(s) or cell surface protein(s) is/are not expressed (e.g., by deletion or disruption of the gene encoding antigen or cell surface protein). In each of the above embodiments, the CAR-T cell may be deficient in one or preferably all the antigens or cell surface proteins to which the chimeric antigen receptor specifically binds. The methods to genetically modify a T cell to be deficient in one or more antigens or cell surface proteins are well known in art and non-limiting examples are provided herein. In embodiments described below, the CRISPR-Cas9 system is used to modify a T cell to be deficient in one or more antigen(s) or cell surface protein(s). Any of these may be accomplished by the methods disclosed herein. In further embodiments, the T cell comprises a suicide gene.

A dCAR for a genome-edited, dual CAR-T cell, i.e., CD2*CD3&-dCARTΔCD2ΔCD38, may be generated by cloning a commercially synthesized anti-CD2 single chain variable fragment into a lentiviral vector containing, e.g., a $2^{nd}$ or $3^{rd}$ generation CAR backbone with CD28 and/or 4-1BB internal signaling domains and cloning a commercially synthesized anti-CD3& single chain variable into the same lentiviral vector containing an additional $2^{nd}$ or $3^{rd}$ generation CAR backbone with CD28 and/or 4-1BB internal signaling domains resulting in a plasmid from which the two CAR constructs are expressed from the same vector. An extracellular hCD34 domain may be added after a P2A peptide to enable both detection of CAR following viral transduction and purification using anti-hCD34 magnetic beads. A similar method may be followed for making tCARs specific for other malignant T cell antigens.

In a similar manner, other dual CARs may be constructed and are given below in Tables 5-7.

In one embodiment, a dual CAR-T cell comprises (i) a first chimeric antigen receptor (CAR) polypeptide comprising a first signal peptide, a first antigen recognition domain, a first hinge region, a first transmembrane domain, a first co-stimulatory domain, and a first signaling domain; and (ii) a second chimeric antigen receptor polypeptide comprising a second signaling peptide, a second antigen recognition domain, a second hinge region, a second transmembrane domain, a second co-stimulatory domain, and a second signaling domain; wherein the first antigen recognition domain and the second antigen recognition domain have affinities for different target antigens; and wherein the dual CAR-T cell possesses one or more genetic disruptions resulting in reduced expression of the target antigen in the dual CAR-T cell.

In a second embodiment, the first signal peptide is a CD8a signal sequence.

In a third embodiment, the first antigen recognition domain is fusion protein of the variable regions of immunoglobulin heavy and light chains, designated $V_H1$ and $V_L1$, for the first antigen recognition domain, connected by a short linker peptide of 5 amino acids (GGGGS (SEQ ID NO: 3065)). In some embodiments, this linker peptide is repeated 3 or 4 times. In some embodiments, the first antigen recognition domain can be selected from $V_H1$-(GGGGS)$_{3-4}$ (SEQ ID NO: 3066)-$V_L1$ or $V_L1$-(GGGGS)$_{3-4}$ (SEQ ID NO: 3066)-$V_H1$.

In some embodiments, the first hinge region comprises CD8a.

In some embodiments, the first transmembrane domain is CD8 or CD28.

In some embodiments, the first co-stimulatory domain comprises 4-1BB, CD28, or a combination of both, in either order, i.e., 4-1BB-CD28 or CD28-4-1BB.

In some embodiments, the first signaling domain is CD3ζ or a CD3 ζ bi-peptide., i.e., CD3ζ-CD3ζ.

In some embodiments, the second signal peptide is a CD8a signal sequence of SEQ NO: 1.

In some embodiments, the second antigen recognition domain is fusion protein of the variable regions of immunoglobulin heavy and light chains, designated $V_H2$ and $V_L2$, for the second antigen recognition domain, connected by a short linker peptide of 5 amino acids (GGGGS (SEQ ID NO: 3065)). In some embodiments, this linker peptide is repeated 3 or 4 times. In some embodiments, the second antigen recognition domain can be selected from $V_H2\text{-}(GGGGS)_{3-4}$ (SEQ ID NO: 3066)-V1.2 or $V_L2\text{-}(GGGGS)_{3-4}$ (SEQ ID NO: 3066)-$V_H2$.

In some embodiments, the second hinge region comprises CD8a.

In some embodiments, the second transmembrane domain is CD8 or CD28.

In some embodiments, the second co-stimulatory domain comprises 4-1BB, CD28, or a combination of both, in either order, i.e., 4-1BB-CD28 or CD28-4-1BB.

In some embodiments, the second signaling domain is CD3ζ or a CD3ζ bi-peptide, i.e., CD3ζ-CD3ζ.

In some embodiments, the CAR polypeptide comprises a first antigen recognition domain fusion protein of $V_H1\text{-}(GGGGS)_{3-4}$ (SEQ ID NO: 3066)-$V_L1$ and a second antigen recognition domain fusion protein of $V_H2\text{-}(GGGGS)_{3-4}$ (SEQ ID NO: 3066)-$V_L2$.

In some embodiments, the CAR polypeptide comprises a first antigen recognition domain fusion protein of $V_L1\text{-}(GGGGS)_{3-4}$ (SEQ ID NO: 3066)-$V_H1$ and a second antigen recognition domain fusion protein of $V_L2\text{-}(GGGGS)_{3-4}$ (SEQ ID NO: 3066)-$V_H2$.

In some embodiments, the CAR polypeptide comprises a first antigen recognition domain fusion protein of $V_H2\text{-}(GGGGS)3.4$ (SEQ ID NO: 3066)-$V_L2$ and a second antigen recognition domain fusion protein of $V_H1\text{-}(GGGGS)_{3-4}$ (SEQ ID NO: 3066)-$V_L1$.

In some embodiments, the CAR polypeptide comprises a first antigen recognition domain fusion protein of $V_L2\text{-}(GGGGS)_{3-4}$ (SEQ ID NO: 3066)-$V_H2$ and a second antigen recognition domain fusion protein of $V_L1\text{-}(GGGGS)_{3-4}$ (SEQ ID NO: 3066)-$V_H1$.

In some embodiments, the CAR polypeptide comprises a first antigen recognition domain fusion protein of $V_H1\text{-}(GGGGS)_{3-4}$ (SEQ ID NO: 3066)-$V_L1$ and a second antigen recognition domain fusion protein of $V_L2\text{-}(GGGGS)_{3-4}$ (SEQ ID NO: 3066)-$V_H2$.

In some embodiments, the CAR polypeptide comprises a first antigen recognition domain fusion protein of $V_L1\text{-}(GGGGS)_{3-4}$ (SEQ ID NO: 3066)-$V_H1$ and a second antigen recognition domain fusion protein of $V_H2\text{-}(GGGGS)_{3-4}$ (SEQ ID NO: 3066)-$V_L2$.

In some embodiments, the CAR polypeptide comprises a first antigen recognition domain fusion protein of $V_H2\text{-}(GGGGS)_{3-4}$ (SEQ ID NO: 3066)-$V_L2$ and a second antigen recognition domain fusion protein of $V_L1\text{-}(GGGGS)_{3-4}$ (SEQ ID NO: 3066)-$V_H1$.

In some embodiments, the CAR polypeptide comprises a first antigen recognition domain fusion protein of V12-$(GGGGS)_{3-4}$ (SEQ ID NO: 3066)-$V_H2$ and a second antigen recognition domain fusion protein of $V_H1\text{-}(GGGGS)_{3-4}$ (SEQ ID NO: 3066)-$V_L1$.

In some embodiments, the CAR polypeptide comprises at least one high efficiency cleavage site, wherein the high efficiency cleavage site is selected from P2A, T2A, E2A, and F2A.

In some embodiments, the CAR polypeptide comprises a suicide gene.

In some embodiments, the CAR polypeptide comprises a mutant cytokine receptor.

In some embodiments, the dual CAR-T cell targets two antigens selected from CD5, CD7, CD2, CD4, CD3, CD33, CD123 (IL3RA), CD371 (CLL-1; CLEC12A), CD117 (c-kit), CD135 (FLT3), BCMA, CS1, CD38, CD79A, CD79B, CD138, and CD19, APRIL, and TACI.

Additional examples of dual CARs are given below in Table 7.

TABLE 7

Dual CARs and dCAR-Ts

| Example | Antigen Targets of CARs in dCAR-T cell | Antigen Deletion/Suppression |
|---|---|---|
| D1 | APRILxBCMA | — |
| D2 | APRILxCD19 | — |
| D3 | APRILxCD38 | — |
| D4 | APRILxCD38 | CD38 |
| D5 | APRILxCS1 | — |
| D6 | APRILxCS1 | CS1 |
| D7 | BCMAxCD19 | — |
| D8 | BCMAxCD38 | — |
| D9 | BCMAxCD38 | CD38 |
| D10 | BCMAxCS1 | — |
| D11 | BCMAxCS1 | CS1 |
| D12 | CD138xAPRIL | |
| D13 | CD138xBCMA | |
| D14 | CD138xCD19 | |
| D15 | CD138xCD38 | |
| D16 | CD138xCD38 | CD38 |
| D17 | CD138xCD79A | |
| D18 | CD138xCD79B | |
| D19 | CD138xCS1 | |
| D20 | CD138xCS1 | CS1 |
| D21 | CD19xCD38 | — |
| D22 | CD19xCD38 | CD38 |
| D23 | CD2xCD3ε | — |
| D24 | CD2xCD3ε | CD2 |
| D25 | CD2xCD3ε | CD3ε |
| D26 | CD2xCD3ε | CD2 and CD3ε |
| D27 | CD2xCD4 | — |
| D28 | CD2xCD4 | CD2 |
| D29 | CD2xCD4 | CD4 |
| D30 | CD2xCD4 | CD2 and CD4 |
| D31 | CD2xCD4 | CD2 and TRAC |
| D32 | CD2xCD4 | CD4 and TRAC |
| D33 | CD2xCD4 | CD2 and CD4 and TRAC |
| D34 | CD2xCD5 | — |
| D35 | CD2xCD5 | CD2 |
| D36 | CD2xCD5 | CD5 |
| D37 | CD2xCD5 | CD2 and CD5 |
| D38 | CD2xCD5 | CD2 and TRAC |
| D39 | CD2xCD5 | CD5 and TRAC |
| D40 | CD2xCD5 | CD2 and CD5 and TRAC |
| D41 | CD2xCD7 | — |
| D42 | CD2xCD7 | CD2 |
| D43 | CD2xCD7 | CD7 |
| D44 | CD2xCD7 | CD2 and CD7 |
| D45 | CD2xCD7 | CD2 and TRAC |
| D46 | CD2xCD7 | CD7 and TRAC |
| D47 | CD2xCD7 | CD2 and CD7 and TRAC |
| D48 | CD3εxCD4 | — |
| D49 | CD3εxCD4 | CD3ε |
| D50 | CD3εxCD4 | CD4 |
| D51 | CD3εxCD4 | CD3ε and CD4 |
| D52 | CD3εxCD5 | — |
| D53 | CD3εxCD5 | CD3ε |
| D54 | CD3εxCD5 | CD5 |
| D55 | CD3εxCD5 | CD3ε and CD5 |

TABLE 7-continued

Dual CARs and dCAR-Ts

| Example | Antigen Targets of CARs in dCAR-T cell | Antigen Deletion/Suppression |
|---|---|---|
| D56 | CD3εxCD7 | — |
| D57 | CD3εxCD7 | CD3ε |
| D58 | CD3εxCD7 | CD7 |
| D59 | CD3εxCD7 | CD3ε and CD7 |
| D60 | CD4xCD5 | — |
| D61 | CD4xCD5 | CD4 |
| D62 | CD4xCD5 | CD5 |
| D63 | CD4xCD5 | CD4 and CD5 |
| D64 | CD4xCD5 | CD4 and TRAC |
| D65 | CD4xCD5 | CD5 and TRAC |
| D66 | CD4xCD5 | CD4 and CD5 and TRAC |
| D67 | CD4xCD7 | — |
| D68 | CD4xCD7 | CD4 |
| D69 | CD4xCD7 | CD7 |
| D70 | CD4xCD7 | CD4 and CD7 |
| D71 | CD4xCD7 | CD4 and TRAC |
| D72 | CD4xCD7 | CD7 and TRAC |
| D73 | CD4xCD7 | CD4 and CD7 and TRAC |
| D74 | CD5xCD7 | — |
| D75 | CD5xCD7 | CD5 |
| D76 | CD5xCD7 | CD7 |
| D77 | CD5xCD7 | CD5 and CD7 |
| D78 | CD5xCD7 | CD5 and TRAC |
| D79 | CD5xCD7 | CD7 and TRAC |
| D80 | CD5xCD7 | CD5 and CD7 and TRAC |
| D81 | CD79AxAPRIL | |
| D82 | CD79AxBCMA | |
| D83 | CD79AxCD19 | |
| D84 | CD79AxCD38 | |
| D85 | CD79AxCD38 | CD38 |
| D86 | CD79AxCD79B | |
| D87 | CD79AxCS1 | |
| D88 | CD79AxCS1 | CS1 |
| D89 | CD79BxAPRIL | |
| D90 | CD79BxBCMA | |
| D91 | CD79BxCD19 | |
| D92 | CD79BxCD38 | |
| D93 | CD79BxCD38 | CD38 |
| D94 | CD79BxCD79A | |
| D95 | CD79BxCS1 | |
| D96 | CD79BxCS1 | CS1 |
| D97 | CS1xCD19 | — |
| D98 | CS1xCD19 | CS1 |
| D99 | CS1xCD38 | — |
| D100 | CS1xCD38 | CS1 |
| D101 | CS1xCD38 | CD38 |
| D102 | CS1xCD38 | CS1 and CD38 |
| D103 | TCRβxCD2 | — |
| D104 | TCRβxCD2 | TCRβ |
| D105 | TCRβxCD2 | CD2 |
| D106 | TCRβxCD2 | TCRβ and CD2 |
| D107 | TCRβxCD3ε | — |
| D108 | TCRβxCD3ε | TCRβ |
| D109 | TCRβxCD3ε | CD3ε |
| D110 | TCRβxCD3ε | TCRβ and CD3ε |
| D111 | TCRβxCD4 | — |
| D112 | TCRβxCD4 | TCRβ |
| D113 | TCRβxCD4 | CD4 |
| D114 | TCRβxCD4 | TCRβ and CD4 |
| D115 | TCRβxCD5 | — |
| D116 | TCRβxCD5 | TCRβ |
| D117 | TCRβxCD5 | CD5 |
| D118 | TCRβxCD5 | TCRβ and CD5 |
| D119 | TCRβxCD7 | — |
| D120 | TCRβxCD7 | TCRβ |
| D121 | TCRβxCD7 | CD7 |
| D122 | TCRβxCD7 | TCRβ and CD7 |
| D123 | TRACxCD2 | — |
| D124 | TRACxCD2 | TRAC |
| D125 | TRACxCD2 | CD2 |
| D126 | TRACxCD2 | TRAC and CD2 |
| D127 | TRACxCD3ε | — |
| D128 | TRACxCD3ε | TRAC |
| D129 | TRACxCD3ε | CD3ε |
| D130 | TRACxCD3ε | TRAC and CD3ε |
| D131 | TRACxCD4 | — |
| D132 | TRACxCD4 | TRAC |
| D133 | TRACxCD4 | CD4 |
| D134 | TRACxCD4 | TRAC and CD4 |
| D135 | TRACxCD5 | — |
| D136 | TRACxCD5 | TRAC |
| D137 | TRACxCD5 | CD5 |
| D138 | TRACxCD5 | TRAC and CD5 |
| D139 | TRACxCD7 | — |
| D140 | TRACxCD7 | TRAC |
| D141 | TRACxCD7 | CD7 |
| D142 | TRACxCD7 | TRAC and CD7 |

Cytokine/Chemokine/Transcription Factor Gene Deletion or Suppression

Cytokine release syndrome (CRS) is caused by a large, rapid release of cytokines from immune cells in response to immunotherapy (or other immunological stimulus). Accordingly, reducing the level of cytokines released would prevent or reduce the development and/or maintenance of CRS. As disclosed herein, this can be accomplished by modifying, disrupting, or deleting one or more cytokine/chemokine/transcription factor genes. One method to accomplish this is genetic ablation (gene silencing) in which gene expression is abolished through the alteration or deletion of genetic sequence information. This can be accomplished using known genetic engineering tools in the art such as Transcription Activator-like Effector Nucleases (TALENs), Zinc Finger Nucleases (ZFNs), CRISPR, and also by transfection of small interfering RNAs (siRNAs).

Another technique is expression of an scFv with an endoplasmic reticulum (ER) binding tether to bind the cytokine in the ER and prevent secretion. Specific constructs, named protein expression blockers (PEBLs), prevent transport of targeted proteins to the cell membrane. PEBL constructs can be readily combined with other gene modification systems for ex vivo cell processing of immune cells. A short hairpin RNA or small hairpin RNA (shRNA/Hairpin Vector) is an artificial RNA molecule with a tight hairpin turn that can be used to silence target gene expression, i.e., of antigens, via RNA interference (RNAi). Expression of shRNA in cells is typically accomplished by delivery of plasmids or through viral or bacterial vectors.

Cytokines or chemokines that can be deleted from immune effector cells as disclosed herein, e.g., by targeted transduction of a CAR into the gene sequence of the cytokine, include without limitation the following: XCL1, XCL2, CCL1, CCL2, CCL3, CCL4, CCL5, CCL7, CCL8, CCL11, CCL13, CCL14, CCL15, CCL16, CCL17, CCL18, CCL19, CCL20, CCL21, CCL22, CCL23, CCL24, CCL25, CCL26, CCL27, CXCL1, CXCL2, CXCL3, CXCL4, CXCL5, CXCL6, CXCL7, CXCL8, CXCL9, CXCL10, CXCL11, CXCL12, CXCL13, CXCL14, CX3CL1, IL-1a, IL-1B, IL-1RA, IL-18, IL-2, IL-4, IL-7, IL-9, IL-13, IL-15, IL-3, IL-5, GM-CSF, IL-6, IL-11, G-CSF, IL-12, LIF, OSM, IL-10, IL-20, IL-14, IL-16, IL-17, IFN-α, IFN-β, IFN-γ, CD154, LT-β, TNF-α,TNF-β, 4-1BBL, APRIL, CD70, CD153, CD178, GITRL, LIGHT, OX40L, TALL-1, TRAIL, TWEAK, TRANCE, TGF-β1, TGF-β2, TGF-β3, Epo, Tpo, Flt-3L, SCF, M-CSF, MSP, A2M, ACKR1, ACKR2, ACKR3, ACVR1, ACVR2B, ACVRL1, ADIPOQ, AGER, AGRN, AIMP1, AREG, BMP1, BMP10, BMP15, BMP2, BMP3, BMP4, BMP5, BMP6, BMP7, BMP8A, BMP8B, BMPR2, C10orf99, C1QTNF4, C5, CCL28, CCR1, CCR2, CCR3, CCR5, CCR6, CCR7, CD109, CD36, CD4, CD40LG, CD74, CER1, CHRD, CKLF, CLCF1, CMTM1, CMTM2, CMTM3, CMTM4, CMTM5, CMTM6, CMTM7, CMTM8, CNTF, CNTFR, COPS5, CRLF1, CSF1, CSF1R, CSF2, CSF3, CSF3R, CTF1, CX3CR1, CXCL16, CXCL17, CXCR1, CXCR2, CXCR3, CXCR4, CXCR6, EBI3, EDNI, ELANE, ENG, FAM3B, FAM3C, FAM3D, FAS, FASLG, FGF2, FLT3LG, FZD4, GBP1, GDF1, GDF10, GDF11, GDF15, GDF2, GDF3, GDF5, GDF6, GDF7, GDF9, GPI, GREM1, GREM2, GRN, HAX1, HFE2, HMGB1, HYAL2, IFNA10, IFNA14, IFNA16, IFNA2, IFNA5, IFNA6, IFNA8, IFNAR1, IFNAR2, IFNB1, IFNE, IFNG, IFNGR1, IFNK, IFNL1, IFNL3, IFNW1, IL1ORA, IL11RA, IL12A, IL12B, IL12RB1, IL17A, IL17B, IL17C, IL17D, IL17F, IL18BP, IL-19, IL1F10, ILIR1, ILIR2, ILIRAPLI, ILIRLI, ILIRN, IL20RA, IL20RB, IL21, IL22, IL22RA1, IL22RA2, IL23A, IL23R, IL24, IL25, IL26, IL27, IL2RA, IL2RB, IL2RG, IL31, IL31RA, IL32, IL33, IL34, IL36A, IL36B, IL36G, IL36RN, IL37, IL6R, IL6ST, INHA, INHBA, INHBB, INHBC, INHBE, ITGA4, ITGAV, ITGB1, ITGB3, KIT, KITLG, KLHL20, LEFTY1, LEFTY2, LIFR, LTA, LTB, LTBP1, LTBP3, LTBP4, MIF, MINOS1-, MSTN, NAMPT, NBL1, NDP, NLRP7, NODAL, NOG, NRG1, NRP1, NRP2, OSMR, PARK7, PDPN, PF4, PF4V1, PGLYRP1, PLP2, PPBP, PXDN, SCG2, SCGB3A1, SECTM1, SLURP1, SOSTDC1, SP100, SPP1, TCAP, TGFBR1, TGFBR2, TGFBR3, THBS1, THNSL2, THPO, TIMP1, TNF, TNFRSF11, TNFRSF1A, TNFRSF9, TNFRSF10, TNFSF11, TNFSF12, TNFSF12-, TNFSF13, TNFSF13B, TNFSF14, TNFSF15, TNFSF18, TNFSF4, TNFSF8, TNFSF9, TRIM16, TSLP, TWSG1, TXLNA, VASN, VEGFA, VSTMI, WFIKKN1, WFIKKN2, WNT1, WNT2, WNT5A, WNT7A, and ZFP36.

In some embodiments, the cytokine is chosen from cytokine is chosen from MCP1 (CCL2), MCP-2, GM-CSF, G-CSF, M-CSF, Il-4, and IFNγ.

In certain embodiments, transcription factors that can be deleted from immune effector cells as disclosed herein include AHR, BCL6, FOXP3, GATA3, MAF, RORC, SPII, and TBX21.

The sequences of these genes are known and available in the art and can include, for example, those provided in Table 10.

Selection of Priority Target Genes

Cytokine/chemokine gene targets of specific interest for deletion or suppression (e.g., ablation, knock-out, KO) in CAR-T cells for the mitigation of CRS have been categorized into groups based on biological function. CRS development is dependent upon CAR-T cell activation and subsequent cytokine release, which initiates a dysregulated immune system in the recipient of the CAR-T cell therapy. Several studies have indicated that recipient myeloid activation is necessary for the development of CRS.

The first group of potential genes to KO in CAR-T are surface receptors that, when engaged with myeloid cells in normal immunological responses activate the myeloid cells (e.g., CD40L). The second group are cytokines that are released from CAR-T cells that activate myeloid cells (e.g., GM-CSF). In both these categories, the goal is to prevent CAR-T cell signaling, which will activate recipient myeloid cells and initiate CRS.

The third category of targets are endogenous T cell receptors that increase T cell activation (potentially in the absence of tumor target) that are integrated into the CAR-T receptor (e.g., endogenous CD28). The aim is to curtail activation of the CAR-T from non-tumor interactions, such as activated myeloid cells that could engage with CD28 on activated T cells, thus amplifying T cell cytokine production and subsequent myeloid activation.

The fourth and fifth categories of gene KO targets are transcription factors and cytokines that drive CAR-T cell differentiation and subsequent functional characteristics. CAR-T cells that are phenotypically similar to normal cytotoxic T cells (CTL, typically identified by CD8 expression) are capable of direct tumor killing through T cell mediated effector functions. CTL are supported and maintained by T helper cells (expressing CD4). Importantly, subsets of T helper cells can support CTL (i.e., Th1 cells) or inhibit (i.e., Th2 cells). Other T cells, such as Tregs can also inhibit CTL development and function. The aim is to target cytokines or transcription factors in the CAR-T population that would lead to CAR-T differentiation into non-cytotoxic T cell populations. Additionally, Th2 cells produce cytokines (such as GM-CSF and IL-4), which are indicative markers of CRS. It is likely that CAR-T phenotypes, which cannot optimally kill tumor cells, will be activated via CAR-T receptors, produce signals that drive CRS in the host, increase the time required for tumor killing, and require higher CAR-T cell doses than optimized "killing" products. Thus, knocking out or ablating (or suppressing) transcription factors (such as GATA3) or cytokines (such as IL-4) will prevent (or reduce) Th2 bias and reduce CRS.

Of additional interest regarding both myeloid activating cytokines and optimized CAR-T cell differentiation is the potential to mitigate CAR-T neurotoxicity. Neurotoxicity occurs in a small population of CAR-T recipients with CRS. Research has shown that CRS patients that progress to develop neurotoxicity have increased IL-5 and ferritin levels (Santomasso et al., 2017 and Philip et al., 2019). These two biomarkers indicate that mast cell activation may be involved with CNS complications. IL-5 is a key cytokine produced by Th2 cells, eosinophils and mast cells. Excessive levels of ferritin are observed in mastocytosis and several diseases involving mast cell dysregulation. Additionally, many mast cell diseases include neurological dysregulation. Given raised levels of IL-5, ferritin, and neurological toxicity in some patients, reducing mast cell activation by cytokines such as IL-5, or preventing Th2 cell development which drives IL-5-dependent mast cell activation, may also mitigate neurological complications seen in CRS recipients. With respect to CNS complications, CX3CR1 and OX40 were also highlighted, due to previously demonstrated high T cell burden in the CNS. CX3CR1 is a T cell chemokine receptor that principally directs T cells and potentially CAR-T cells into the CNS. OX40 is the T cell receptor which facilitates activation by cell-cell interaction with OX40L on eosinophils and mast cells.

Thus, in certain embodiments, the cytokine is chosen from CCL2 (MCP1), MCP-2, GM-CSF, G-CSF, M-CSF, Il-4, and IFNγ.

Indications and Standards of Care in CAR-T Therapy

In some embodiment, the genome-edited immune effector cells disclosed herein, and/or generated using the methods disclosed herein, express one or more chimeric antigen receptors (CARs) and can be used as a medicament, i.e., for the treatment of disease. In many embodiments, the cells are CAR-T cells.

Cells disclosed herein, and/or generated using the methods disclosed herein, may be used in immunotherapy and adoptive cell transfer, for the treatment, or the manufacture of a medicament for treatment, of cancers, autoimmune diseases, infectious diseases, and other conditions.

The cancer may be a hematologic malignancy or solid tumor. Hematologic malignancies include leukemias, lymphomas, multiple myeloma, and subtypes thereof. Lymphomas can be classified various ways, often based on the underlying type of malignant cell, including Hodgkin's lymphoma (often cancers of Reed-Sternberg cells, but also sometimes originating in B cells; all other lymphomas are non-Hodgkin's lymphomas), B-cell lymphomas, T-cell lymphomas, mantle cell lymphomas, Burkitt's lymphoma, follicular lymphoma, and others as defined herein and known in the art.

B-cell lymphomas include, but are not limited to, diffuse large B-cell lymphoma (DLBCL), chronic lymphocytic leukemia (CLL)/small lymphocytic lymphoma (SLL), and others as defined herein and known in the art.

T-cell lymphomas include T-cell acute lymphoblastic leukemia/lymphoma (T-ALL),, peripheral T-cell lymphoma (PTCL), T-cell chronic lymphocytic leukemia (T-CLL) Sezary syndrome, and others as defined herein and known in the art.

Leukemias include Acute myeloid (or myelogenous) leukemia (AML), chronic myeloid (or myelogenous) leukemia (CML), acute lymphocytic (or lymphoblastic) leukemia (ALL), chronic lymphocytic leukemia (CLL) hairy cell leukemia (sometimes classified as a lymphoma), and others as defined herein and known in the art.

Plasma cell malignancies include lymphoplasmacytic lymphoma, plasmacytoma, and multiple myeloma.

In some embodiments, the medicament can be used for treating cancer in a patient, particularly for the treatment of solid tumors such as melanomas, neuroblastomas, gliomas or carcinomas such as tumors of the brain, head and neck, breast, lung (e.g., non small cell lung cancer, NSCLC), reproductive tract (e.g., ovary), upper digestive tract, pancreas, liver, renal system (e.g., kidneys), bladder, prostate and colorectum.

In another embodiment, the medicament can be used for treating cancer in a patient, particularly for the treatment of hematologic malignancies selected from multiple myeloma and acute myeloid leukemia (AML) and for T-cell malignancies selected from T-cell acute lymphoblastic leukemia (T-ALL), non-Hodgkin's lymphoma, and T-cell chronic lymphocytic leukemia (T-CLL).

In some embodiments, the cells may be used in the treatment of autoimmune diseases such as lupus, autoimmune (rheumatoid) arthritis, multiple sclerosis, transplant rejection, Crohn's disease, ulcerative colitis, dermatitis, and the like. In some embodiments, the cells are chimeric autoantibody receptor T-cells, or CAAR-Ts displaying antigens or fragments thereof, instead of antibody fragments; in this version of adoptive cell transfer, the B cells that cause autoimmune diseases will attempt to attack the engineered T cells, which will respond by killing them.

In some embodiments, the cells may be used in the treatment of infectious diseases such as HIV and tuberculosis.

In another embodiment, the CAR-T cells of the present disclosure can undergo robust in vivo T cell expansion and can persist for an extended amount of time.

In some embodiments, the treatment of a patient with CAR-T cells of the present disclosure can be ameliorating, curative or prophylactic. It may be either part of an autologous immunotherapy or part of an allogenic immunotherapy treatment. By autologous, it is meant that cells, cell line or population of cells used for treating patients are originating from said patient or from a Human Leucocyte Antigen (HLA) compatible donor. By allogeneic, is meant that the cells or population of cells used for treating patients are not originating from the patient but from a donor.

The treatment of cancer with CAR-T cells of the present disclosure may be in combination with one or more therapies selected from antibody therapy, chemotherapy, cytokine therapy, dendritic cell therapy, gene therapy, hormone therapy, radiotherapy, laser light therapy, and radiation therapy.

The administration of CAR-T cells or a population of CAR-T cells of the present disclosure of the present disclosure be carried out by aerosol inhalation, injection, ingestion, transfusion, implantation or transplantation. The CAR-T cells compositions described herein, i.e., mono CAR, dual CAR, tandem CARs, may be administered to a patient subcutaneously, intradermally, intratumorally, intranodally, intramedullary, intramuscularly, by intravenous or intralymphatic injection, or intraperitoneally. In one embodiment, the cell compositions of the present disclosure are preferably administered by intravenous injection.

The administration of CAR-T cells or a population of CAR-T cells can consist of the administration of $10^4$-$10^9$ cells per kg body weight, preferably $10^5$ to $10^6$ cells/kg body weight including all integer values of cell numbers within those ranges. The CAR-T cells or a population of CAR-T cells can be administrated in one or more doses. In another embodiment, the effective amount of CAR-T cells or a population of CAR-T cells are administrated as a single dose. In another embodiment, the effective amount of cells are administered as more than one dose over a period time. Timing of administration is within the judgment of a health care provider and depends on the clinical condition of the patient. The CAR-T cells or a population of CAR-T cells may be obtained from any source, such as a blood bank or a donor. While the needs of a patient vary, determination of optimal ranges of effective amounts of a given CAR-T cell population(s) for a particular disease or conditions are within the skill of the art. An effective amount means an amount which provides a therapeutic or prophylactic benefit. The dosage administered will be dependent upon the age, health and weight of the patient recipient, type of concurrent treatment, if any, frequency of treatment, and the nature of the effect desired.

In another embodiment, the effective amount of CAR-T cells or a population of CAR-T cells or composition comprising those CAR-T cells are administered parenterally. The administration can be an intravenous administration. The administration of CAR-T cells or a population of CAR-T cells or composition comprising those CAR-T cells can be directly done by injection within a tumor.

In one embodiment of the present disclosure, the CAR-T cells or a population of the CAR-T cells are administered to a patient in conjunction with, e.g., before, simultaneously or following, any number of relevant treatment modalities, including but not limited to, treatment with cytokines, or expression of cytokines from within the CAR-T, that enhance T-cell proliferation and persistence and, include but not limited to, IL-2, IL-7, and IL-15.

In a second embodiment, the CAR-T cells or a population of CAR-T cells of the present disclosure may be used in combination with agents that inhibit immunosuppressive pathways, including but not limited to, inhibitors of TGF-β, interleukin 10 (IL-10), adenosine, VEGF, indoleamine 2,3 dioxygenase 1 (IDO1), indoleamine 2,3-dioxygenase 2 (IDO2), tryptophan 2-3-dioxygenase (TDO), lactate, hypoxia, arginase, and prostaglandin E2.

In another embodiment, the CAR-T cells or a population of CAR-T cells of the present disclosure may be used in combination with T-cell checkpoint inhibitors, including but not limited to, anti-CTLA4 (Ipilimumab) anti-PDI (Pembrolizumab, Nivolumab, Cemiplimab), anti-PDL1 (Atezolizumab, Avelumab, Durvalumab), anti-PDL2, anti-BTLA, anti-LAG3, anti-TIM3, anti-VISTA, anti-TIGIT, and anti-KIR.

In another embodiment, the CAR-T cells or a population of CAR-T cells of the present disclosure may be used in combination with T cell agonists, including but not limited to, antibodies that stimulate CD28, ICOS, OX-40, CD27, 4-1BB, CD137, GITR, and HVEM In another embodiment, the CAR-T cells or a population of CAR-T cells of the present disclosure may be used in combination with therapeutic oncolytic viruses, including but not limited to, retroviruses, picornaviruses, rhabdoviruses, paramyxoviruses, reoviruses, parvoviruses, adenoviruses, herpesviruses, and poxviruses.

In another embodiment, the CAR-T cells or a population of CAR-T cells of the present disclosure may be used in combination with immunostimulatory therapies, such as toll-like receptors agonists, including but not limited to, TLR3, TLR4, TLR7 and TLR9 agonists.

In another embodiment, the CAR-T cells or a population of CAR-T cells of the present disclosure may be used in combination with stimulator of interferon gene (STING) agonists, such as cyclic GMP-AMP synthase (cGAS).

Immune effector cell aplasia, particularly T cell aplasia is also a concern after adoptive cell transfer therapy. When the malignancy treated is a T-cell malignancy, and CAR-T cells target a T cell antigen, normal T cells and their precursors expressing the antigen will become depleted, and the immune system will be compromised. Accordingly, methods for managing these side effects are attendant to therapy. Such methods include selecting and retaining non-malignant T cells or precursors, either autologous or allogeneic (optionally engineered not to cause rejection or be rejected), for later expansion and re-infusion into the patient, after CAR-T cells are exhausted or deactivated. Alternatively, CAR-T cells which recognize and kill subsets of TCR-bearing cells, such as normal and malignant TRBC1+, but not TRBC2+ cells, or alternatively, TRBC2+, but not TRBC1+ cells, may be used to eradicate a T cell malignancy while preserving sufficient normal T cells to maintain normal immune system function.

Definitions

As used herein, the terms below have the meanings indicated. Other definitions may occur throughout the specification.

When ranges of values are disclosed, and the notation "from $n_1$ ... to $n_2$" or "between $n_1$ ... and $n_2$" is used, where $n_1$ and $n_2$ are the numbers, then unless otherwise specified, this notation is intended to include the numbers themselves and the range between them. This range may be integral or continuous between and including the end values. By way of example, the range "from 2 to 6 carbons" is intended to include two, three, four, five, and six carbons, since carbons come in integer units. Compare, by way of example, the range "from 1 to 3 μM (micromolar)," which is intended to include 1 μM, 3 μM, and everything in between to any number of significant figures (e.g., 1.255 μM, 2.1 μM, 2.9999 μM, etc.).

The term "about," as used herein, is intended to qualify the numerical values which it modifies, denoting such a value as variable within a margin of error. When no particular margin of error, such as a standard deviation to a mean value given in a chart or table of data, is recited, the term "about" should be understood to mean that range which would encompass the recited value and the range which would be included by rounding up or down to that figure as well, taking into account significant figures.

The term "activation" (and other conjugations thereof) in reference to cells is generally understood to be synonymous with "stimulating" and as used herein refers to treatment of cells that results in expansion of cell populations. In T cells, activation is often accomplished by exposure to CD2 and CD28 (and sometimes CD2 as well) agonists, typically antibodies, optionally coated onto magnetic beads or conjugated to a colloidal polymeric matrix.

The term "antigen" as used herein is a cell surface protein recognized by (i.e., that is the target of) T cell receptor or chimeric antigen receptor. In the classical sense antigens are substances, typically proteins, that are recognized by antibodies, but the definitions overlap insofar as the CAR comprises antibody-derived domains such as light ($V_L$) and heavy ($V_H$) chains recognizing one or more antigen(s).

The term "cancer" refers to a malignancy or abnormal growth of cells in the body. Many different cancers can be characterized or identified by particular cell surface proteins or molecules. Thus, in general terms, cancer in accordance with the present disclosure may refer to any malignancy that may be treated with an immune effector cell, such as a CAR-T cell as described herein, in which the immune effector cell recognizes and binds to the cell surface protein on the cancer cell. As used herein, cancer may refer to a hematologic malignancy, such as multiple myeloma, a T-cell malignancy, or a B cell malignancy. T cell malignancies may include, but are not limited to, T-cell acute lymphoblastic leukemia (T-ALL) or non-Hodgkin's lymphoma. A cancer may also refer to a solid tumor, such as including, but not limited to, cervical cancer, pancreatic cancer, ovarian cancer, mesothelioma, and lung cancer.

A "cell surface protein" as used herein is a protein (or protein complex) expressed by a cell at least in part on the surface of the cell. Examples of cell surface proteins include the TCR (and subunits thereof) and CD7.

The term "combination therapy" means the administration of two or more therapeutic agents to treat a therapeutic condition or disorder described in the present disclosure. Such administration encompasses co-administration of these therapeutic agents in a substantially simultaneous manner, such as in a single capsule having a fixed ratio of active ingredients or in multiple, separate capsules for each active ingredient. In addition, such administration also encompasses use of each type of therapeutic agent in a sequential manner. In either case, the treatment regimen will provide beneficial effects of the drug combination in treating the conditions or disorders described herein.

The term "composition" as used herein refers to an immunotherapeutic cell population combination with one or more therapeutically acceptable carriers.

The term "disease" as used herein is intended to be generally synonymous, and is used interchangeably with, the terms "disorder," "syndrome," and "condition" (as in medical condition), in that all reflect an abnormal condition of the human or animal body or of one of its parts that impairs normal functioning, is typically manifested by distinguishing signs and symptoms, and causes the human or animal to have a reduced duration or quality of life.

The term "donor template" refers to the reference genomic material that the cell uses as a template to repair the a double-stranded break through the homology-directed repair (HDR) DNA repair pathway. The donor template contains the piece of DNA to be inserted into the genome (containing the gene to be expressed, CAR, or marker) with two homology arms flanking the site of the double-stranded break. In some embodiments, a donor template may be an adeno-associated virus, a single-stranded DNA, or a double-stranded DNA.

The term "fratricide" as used herein means a process which occurs when a CAR-T cell (or other CAR-bearing immune effector cell) becomes the target of, and is killed by, another CAR-T cell comprising the same chimeric antigen receptor as the target of CAR-T cell, because the targeted cell expresses the antigen specifically recognized by the chimeric antigen receptor on both cells. CAR-T comprising a chimeric antigen receptor which are deficient in an antigen to which the chimeric antigen receptor specifically binds will be "fratricide-resistant."

The term "genome-edited" or "gene-edited" as used herein means having a gene or potion of the genome added, deleted, or modified (e.g., disrupted) to be non-functional. Thus, in certain embodiments, a "genome-edited T cell" is a T cell that has had a gene such as a CAR recognizing at least one antigen added; and/or has had a gene such as the gene(s) to the antigen(s) that are recognized by the CAR deleted, and/or has had the gene to the TCR or a subunit thereof disrupted.

A "healthy donor," as used herein, is one who does not have a malignancy (particularly a hematologic malignancy, e.g., a T-cell malignancy).

As used herein, an "immature dendritic cell" or "iDC" refers to an immature dendritic cell.

The term "therapeutically acceptable" refers to substances which are suitable for use in contact with the tissues of patients without undue toxicity, irritation, and allergic response, are commensurate with a reasonable benefit/risk ratio, and/or are effective for their intended use.

The term "therapeutically effective" is intended to qualify the amount of active ingredients used in the treatment of a disease or disorder or on the effecting of a clinical endpoint.

The term "patient" is generally synonymous with the term "subject" and includes all mammals including humans.

A "malignant B cell" is a B cell derived from a B-cell malignancy. B cell malignancies include, without limitation, (DLBCL), chronic lymphocytic leukemia (CLL)/small lymphocytic lymphoma (SLL), and B cell-precursor acute lymphoblastic leukemia (ALL).

The term "exposing to," as used herein, in the context of bringing compositions of matter (such as antibodies) into intimate contact with other compositions of matter (such as cells), is intended to be synonymous with "incubated with," and no lengthier period of time in contact is intended by the use of one term instead of the other.

A "malignant T cell" is a T cell derived from a T-cell malignancy. The term "T-cell malignancy" refers to a broad, highly heterogeneous grouping of malignancies derived from T-cell precursors, mature T cells, or natural killer cells. Non-limiting examples of T-cell malignancies include T-cell acute lymphoblastic leukemia/lymphoma (T-ALL),, human T-cell leukemia virus type 1-positive (HTLV-1+) adult T-cell leukemia/lymphoma (ATL), T-cell prolymphocytic leukemia (T-PLL), Adult T-cell lymphoma/leukemia (HTLV-1 associated), Aggressive NK-cell leukemia, Anaplastic large-cell lymphoma (ALCL), ALK positive, Anaplastic large-cell lymphoma (ALCL), ALK negative, Angioimmunoblastic T-cell lymphoma (AITL), Breast implant-associated anaplastic large-cell lymphoma, Chronic lymphoproliferative disorder of NK cells, Extra nodal NK/T-cell lymphoma, nasal type, Enteropathy-type T-cell lymphoma, Follicular T-cell lymphoma, Hepatosplenic T-cell lymphoma, Indolent T-cell lymphoproliferative disorder of the GI tract, Monomorphic epitheliotrophic intestinal T-cell lymphoma, Mycosis fungoides, Nodal peripheral T-cell lymphoma with TFH phenotype, Peripheral T-cell lymphoma (PTCL), NOS, Primary cutaneous α/β T-cell lymphoma, Primary cutaneous CD8+ aggressive epidermotropic cytotoxic T-cell lymphoma, Primary cutaneous acral CD8+ T-cell lymphoma, Primary cutaneous CD4+ small/medium T-cell lymphoproliferative disorders [Primary cutaneous anaplastic large-cell lymphoma (C-ALCL), lymphoid papulosis], Sezary syndrome, Subcutaneous, panniculitis-like T-cell lymphoma, Systemic EBV+ T-cell lymphoma of childhood, and T-cell large granular lymphocytic leukemia (LGL).

A "malignant plasma cell" is a plasma cell derived from a plasma cell malignancy. The term "plasma-cell malignancy" refers to a malignancy in which abnormal plasma cells are overproduced. Non-limiting examples of plasma cell malignancies include lymphoplasmacytic lymphoma, plasmacytoma, and multiple myeloma.

As used herein, "suicide gene" refers to a nucleic acid sequence introduced to a CAR-T cell by standard methods known in the art, that when activated result in the death of the CAR-T cell. If required suicide genes may facilitate the tracking and elimination, i.e., killing, of CAR-T cells in vivo. Facilitated killing of CAR-T cells by activating a suicide gene can be accomplished by standard methods known in the art. Suicide gene systems known in the art include, but are not limited to, several herpes simplex virus thymidine kinase (HSVtk)/ganciclovir (GCV) suicide gene therapy systems and inducible caspase 9 proteins. In one embodiment, the suicide gene is a chimeric CD34/thymidine kinase.

As used herein, an "immune effector cell" is a leukocyte that can modulate an immune response. Immune effector cells include T cells, B cells, natural killer (NK) cells, iNKT cells (invariant T-cell receptor alpha natural killer T cells), and macrophages. T cell receptor (TCR)-bearing immune effector cells include, of course, T cells, but also cells which have been engineered to express a T cell receptor. Immune effector cells may be obtained or derived/generated from any appropriate source, such as including, but not limited to, healthy donors, peripheral blood mononuclear cells, cord blood, and induced pluripotent stem cells (iPSC).

As used herein, a "CAR-bearing immune effector cell" is an immune effector cell which has been transduced with at least one CAR. A "CAR-T cell" is a T cell which has been transduced with at least one CAR; CAR-T cells can be mono, dual, or tandem CAR-T cells. CAR-T cells can be autologous, meaning that they are engineered from a subject's own cells, or allogeneic, meaning that the cells are sourced from a healthy donor, and in many cases, engineered so as not to provoke a host-vs-graft or graft-vs-host reaction.

A "chimeric antigen receptor" or "CAR" as used herein and generally used in the art, refers to a recombinant fusion protein that has an extracellular ligand-binding domain, a transmembrane domain, and a signaling transducing domain that directs the cell to perform a specialized function upon binding of the extracellular ligand-binding domain to a component present on the target cell. For example, a CAR can have an antibody-based specificity for a desired antigen (e.g., tumor antigen) with a T cell receptor-activating intracellular domain to generate a chimeric protein that exhibits specific anti-target cellular immune activity. First-generation CARs include an extracellular ligand-binding domain and signaling transducing domain, commonly CD3ζ or FcεRIγ. Second generation CARs are built upon first generation CAR constructs by including an intracellular costimulatory domain, commonly 4-1BB or CD28. These costimulatory domains help enhance CAR-T cell cytotoxicity and proliferation compared to first generation CARs. The third generation CARs include multiple costimulatory domains, primarily to increase CAR-T cell proliferation and persistence. Chimeric antigen receptors are distinguished from other antigen binding agents by their ability both to bind MHC-independent antigens and transduce activation signals via their intracellular domain.

The term "CAR-iNKT cell" (equivalently, iNKT-CAR) means an iNKT cell that expresses a chimeric antigen receptor. A dual iNKT-CAR cell (equivalently, iNKT-dCAR) is an iNKT-CAR cell that expresses two distinct chimeric antigen receptor polypeptides with affinity to different target antigens expressed within the same effector cell, wherein each CAR functions independently. The CAR may be expressed from a single or multiple polynucleotide sequences. A tandem INKT-CAR cell (equivalently, iNKT-tCAR) is an iNKT-CAR cell with a single chimeric antigen polypeptide containing two distinct antigen recognition domains with affinity to different targets, wherein the antigen recognition domains are linked through a peptide linker and share common costimulatory domain(s), and wherein binding of either antigen recognition domain will signal though a common costimulatory domains(s) and signaling domain.

The term "chimeric antigen receptor T cell" (equivalently, CAR-T) means an T cell that expresses a chimeric antigen receptor.

The term dual CAR-T (dCAR-T), means a CAR-T cell that expresses cells two distinct chimeric antigen receptor polypeptides with affinity to different target antigen expressed within the same effector cell, wherein each CAR functions independently. The CAR may be expressed from single or multiple polynucleotide sequences.

The term tandem CAR-T (tCAR-T) means a single chimeric antigen polypeptide containing two distinct antigen recognition domains with affinity to different targets wherein the antigen recognition domain is linked through a peptide linker and share common costimulatory domain(s), wherein the binding of either antigen recognition domain will signal through a common co-stimulatory domains(s) and signaling domain.

As used herein, a chimeric antigen receptor natural killer (NK) cell (equivalently, NK-CAR) would have a meaning analogous to the definitions of CAR-T and iNKT-CAR.

As used herein, a chimeric antigen receptor macrophage (equivalently, CAR-macrophage) would have a meaning analogous to the definitions of CAR-T, INKT-CAR, and NK-CAR.

As used herein, the term "cytokine release syndrome" refers to a condition that may occur after treatment with some types of immunotherapy, such as monoclonal antibodies and CAR-T or other CAR-bearing immune effector cells. Cytokine release syndrome is caused by a large, rapid release of cytokines into the blood from immune cells affected by the immunotherapy. Symptoms of CRS include fever, fatigue, loss of appetite, muscle and joint pain, nausea, vomiting, diarrhea, rashes, fast breathing, rapid heartbeat, low blood pressure, seizures, headache, confusion, delirium, hallucinations, tremor, and loss of coordination. CRS can manifest along a spectrum of mild to fatal, and can be ranked by severity as follows:

Grade 1: Mild reaction, infusion interruption not indicated; intervention not indicated Grade 2: Therapy or infusion interruption indicated but responds promptly to symptomatic treatment (e.g., anti-histamines, NSAIDS, narcotics, IV fluids); prophylactic medications indicated for <=24 hrs Grade 3: Prolonged (e.g., not rapidly responsive to symptomatic medication and/or brief interruption of infusion); recurrence of symptoms following initial improvement; hospitalization indicated for clinical sequelae (e.g., renal impairment, pulmonary infiltrates)

Grade 4: Life-threatening consequences; pressor or ventilatory support indicated Grade 5: Death See, e.g., "Common Terminology Criteria for Adverse Events (CTCAE) Version v4.03," National Institutes of Health and National Cancer Institute, Jun. 14, 2010; Lee D W et al., "Current concepts in the diagnosis and management of cytokine release syndrome," *Blood* 2014 124 (2): 188-95.

As used herein, the term "CAR-T associated neuropathy" means neuropathy that arises subsequent to administration of CAR-T therapy to a patient, often after intervening cytokine release syndrome has occurred and subsided. The term is relatively new, mainly because CAR-T therapy is relatively new; see, e.g., Vasthie P and Breitbart W S, "Chimeric antigen receptor T-cell neuropsychiatric toxicity in acute lymphoblastic leukemia," Palliat Support Care. 2017 August; 15 (4): 499-503. Accordingly, CAR-T associated neuropathy should be understood at this time to be equivalent to the term "CAR-bearing immune effector cell associated neuropathy," since similar neuropathy could arise from therapy with, e.g., iNKT-CARs or NK-CARs.

As used herein, a "cytokine" is one of a class of small (~5-20 kDa), soluble signaling proteins that are that are synthesized and secreted by certain cells of the immune system at variable, and occasionally locally high, concentrations and by binding to receptors on other cells, send signals to and have an effect on those cells. A "chemokine" is a chemotactic cytokine, i.e., a subspecies of cytokine that is able to induce chemotaxis in nearby responsive cells.

As used herein, to be "deficient" in a cytokine or protein means to lack sufficient quantity of the cytokine or protein for the cytokine or protein to elicit its normal effect. A cell that is "deficient" in GM-CSF, for example, (a "GM-CSF deficient" cell) could be entirely lacking in GM-CSF, but it also could express such a negligible quantity of GM-CSF that the GM-CSF present could not contribute in any meaningful way to the development or maintenance of cytokine release syndrome.

The term "deletion" as used herein in reference to the effect of editing on a gene or its protein product, means alteration or loss of part the sequence of DNA encoding the protein so as to reduce or prevent expression of the protein product. The term "suppression" in the same context means to reduce expression of the protein product; and the term "ablation" in the same context means to knock out (KO) or prevent expression of the protein product. Deletion encompasses suppression and ablation.

As used herein, a "secretable protein" is s protein secreted by a cell which has an effect on other cells. By way of example, secretable proteins include cytokines, chemokines, and transcription factors.

As used herein, a "selectable marker" refers to a marker that allows distinguishing between different cell types, such as a cell into which a CAR has been successfully inserted (i.e., a gene-edited or modified cell). Selectable markers are well known in the art and materials and methods for their use are readily available. In some embodiments, a selectable marker appropriate in accordance with the present disclosure may be a fluorescent protein gene, such as including, but not limited to, a green fluorescence (GFP) gene or a yellow fluorescent protein (YFP) gene. In some embodiments, a selectable marker may be a splice variant of a CD34 gene, such as a truncated CD34 (tCD34) gene or a truncated EGFR (tEGFR) gene. In some embodiments, a selectable marker described herein, such as GFP, or others known and available in the art, may be inserted alone into a gene as described herein (i.e., without a CAR), or may be inserted as a component of a construct comprising the selectable marker and a CAR.

As used herein, a "short hairpin RNA" or "small hairpin RNA" (shRNA) is an artificial RNA molecule, often about 80 base pairs in length and with a tight hairpin turn, that can be used to silence target gene expression via processing within the cell into siRNA which in turn knocks down gene expression. ShRNAs can be incorporated into genomic DNA, and provide stable and long-lasting expression.

As used herein, "transduction" is the process by which foreign DNA is introduced into a cell by a virus or viral vector such as a plasmid, for example by short hairpin RNAs (shRNAs); it often provides long-lasting or permanent silencing of a gene. It may be accomplished by methods known in the art, including electroporation.

Transfection is the process of deliberately introducing purified nucleic acids into eukaryotic cells, for example small interfering RNAs (siRNAs); it produces transient silencing of a gene by RNA interference with mRNA transcripts. Transduction is the process by which foreign DNA is introduced into a cell by a virus or viral vector such as a plasmid, for example by short hairpin RNAs (shRNAs); it often provides long-lasting or permanent silencing of a gene. Both may be accomplished by methods known in the art, including electroporation.

EXAMPLES

The invention is further illustrated by the following examples.

Example 1—Method of Blocking Gene Translation by CAR Insertion

FIG. 1 shows the deletion of a cytokine gene by using Cas9/CRISPR to target a locus in a cytokine gene, then use homology-directed repair to insert the CAS construct. Optionally, the CAS construct would contain a marker, such as a selectable marker as described herein. One challenge with this concept is that is hard to select and sort out the cells have been edited from those that still express the cytokine/chemokine. One way to overcome this is to insert the CAR construct containing a marker, into gene that has been deleted. It has previously been demonstrated that inserting CAR19 into the TRAC gene allows the selection of TRAC-negative, CAR-positive cells. This would allow sorting of cells that have both expression of the car and have the cytokine deleted. Another alternative would be to express a shRNA from the CAR construct that would degrade the RNA encoding for the cytokine without altering the genome. A marker on the CAR construct (such as the truncated CD34 marker) could be used to select cells that downregulate the cytokine and express the CAR, i.e., CAR+=Cytokine negative.

Figure 2:
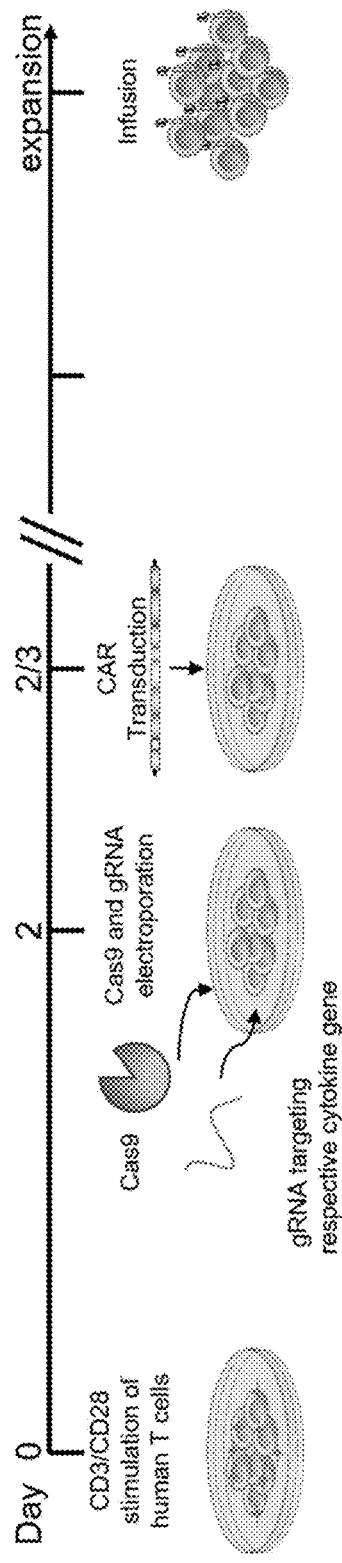
FIG. 2—Shows a timeline for a method of treatment of hematologic malignancies using the CAR-T cells disclosed herein. Those of skill in the art will appreciate that some flexibility is possible in the time frames shown.

As shown in FIG. 2, CAR-bearing immune effector cells (e.g., CAR-T) would be activated for two days prior to gene editing to delete the target cytokine gene and transduction of CAR.

Example 2—General Method of Making Genome-Edited CAR-Bearing Immune Effector Cells Further details regarding the manner of making CAR-bearing immune effector cells are known in the art, e.g., as disclosed in WO2018027036A1.

The following general steps may be taken to provide CAR-bearing immune effector cells. As those of skill in the art will recognize, certain of the steps may be conducted sequentially or out of the order listed below, though perhaps leading to different efficiency.

Step 1. Cells are harvested, isolated, and purified, for example using magnetic selection with a labelled antibody-coated magnetic beads that bind to a cell-specific protein (available from, e.g., Miltenyi Biotec). For T cells, anti-CD3/CD28 beads could be used. Other purification techniques are known in the art and could be used.

Step 3. Cells are thereafter activated. There are several ways to activate immune effector cells. For example, T cells may be activated using antiCD3/CD28 beads for two days prior to bead removal. Alternatively, an antibody could be used.

Step 4. The antigen that is the target of the CAR may be deleted from the cell surface or its expression suppressed to prevent subsequent fratricide. Target deletion may be accomplished by electroporation with Cas9 mRNA and gRNA against the target(s). Other techniques, however, could be used to suppress expression of the target. These include other genome editing techniques such as TALENs, ZFNs, RNA interference, and eliciting of internal binding of the antigen to prevent cell surface expression. Deletion of the target may not be required in every circumstance. Examples of gRNAs that may be used include those shown in Tables 8-10, as well as others known in the art.

TABLE 8

Guide RNA sequences for use in removing surface antigens on immune effector cells

| Target gene | gRNA sequence |
|---|---|
| CD7 | 5'_2'OMe(A(ps)U(pS)C(ps))ACGGAGGUCAAUGUCUAGUUUUAGAGCUAGA AAUAGCAAGUUAAAAUAAGGCUAGUCCGUUAUCAACUUGAAAAAGUG GCACCGAGUCGGUGC2'OMe(U(ps)U(ps)U(ps)U_3' (SEQ ID NO: 40) |
| CD7g10 | 5'_2'OMe(G(ps)U(ps)A(ps))GACAUUGACCUCCGUGAGUUUUAGAGCUAGA AAUAGCAAGUUAAAAUAAGGCUAGUCCGUUAUCAACUUGAAAAAGUG GCACCGAGUCGGUGC2'OMe(U(ps)U(ps)U(ps)U_3' (SEQ ID NO: 41) |

TABLE 8-continued

Guide RNA sequences for use in removing surface
antigens on immune effector cells

| Target gene | gRNA sequence |
|---|---|
| CD7g4 | 5'_2'OMe(A(ps)U(ps)C(ps))ACGGAGGUCAAUGUCUAGUUUUAGAGCUAGA<br>AAUAGCAAGUUAAAAUAAGGCUAGUCCGUUAUCAACUUGAAAAAGUG<br>GCACCGAGUCGGUGC2'OMe(U(ps)U(ps)U(ps)U_3' (SEQ ID NO: 42) |
| TRACg | 5'_2'OMe(G(ps)A(ps)G(ps))AAUCAAAAUCGGUGAAUGUUUUAGAGCUAGA<br>AAUAGCAAGUUAAAAUAAGGCUAGUCCGUUAUCAACUUGAAAAAGUG<br>GCACCGAGUCGGUGC2'OMe(U(ps)U(ps)U(ps)U_3' (SEQ ID NO: 43) |
| CS1 | 5'_2'OMe(G(ps)A(ps)C(ps))CAAUCUGACAUGCUGCAGUUUUAGAGCUAGA<br>AAUAGCAAGUUAAAAUAAGGCUAGUCCGUUAUCAACUUGAAAAAGUG<br>GCACCGAGUCGGUGC2'OMe(U(ps)U(ps)U(ps)U_3' (SEQ ID NO: 44) |
| CD2 | 5'_2'OMe(A(ps)C(ps)A(ps))GCUGACAGGCUCGACACGUUUUAGAGCUAGA<br>AAUAGCAAGUUAAAAUAAGGCUAGUCCGUUAUCAACUUGAAAAAGUG<br>GCACCGAGUCGGUGC2'OMe(U(ps)U(ps)U(ps) U_3' (SEQ ID NO: 45) |
| CD2g | 5'_2'OMe(G(ps)A(ps)G(ps))AAUCAAAAUCGGUGAAUGUUUUAGAGCUAGA<br>AAUAGCAAGUUAAAAUAAGGCUAGUCCGUUAUCAACUUGAAAAAGUG<br>GCACCGAGUCGGUGC2'OMe(U(ps)U(ps)U(ps) U 3' (SEQ ID NO: 46) |
| CD3εg | 5'_2'OMe(A(ps)G(ps)G(ps))GCAUGUCAAUAUUACUGGUUUUAGAGCUAGA<br>AAUAGCAAGUUAAAAUAAGGCUAGUCCGUUAUCAACUUGAAAAAGUG<br>GCACCGAGUCGGUGC2'OMe(U(ps)U(ps)U(ps) U 3' (SEQ ID NO: 47) |
| CD5 | 5'_2'OMe(C(ps)G(ps)U(ps))UCCAACUCGAAGUGCCAGUUUUAGAGCUAGA<br>AAUAGCAAGUUAAAAUAAGGCUAGUCCGUUAUCAACUUGAAAAAGUG<br>GCACCGAGUCGGUGC2'OMe(U(ps)U(ps)U(ps))U3' (SEQ ID NO: 48) |
| CD5g | 5'_2'OMe(C(ps)G(ps)U(ps))uCCAACUCGAAGUGCCAGUUUUAGAGCUAGA<br>AAUAGCAAGUUAAAAUAAGGCUAGUCCGUUAUCAACUUGAAAAAGUG<br>GCACCGAGUCGGUGC2'OMe(U(ps)U(ps)U(ps)U_3' (SEQ ID NO: 49) |

RNA; (ps) indicate phosphorothioate.
Underlined bases denote target sequence.

Step 5. Cells may then be transduced with a CAR targeted to (i.e., that recognizes) one or more antigen or protein targets, for example with a lentivirus containing a CAR construct. Any other suitable method of transduction/transfection may be used, for example transfection using DNA-integrating viral or non-viral vectors containing transposable elements, or transient expressing of non-DNA integrating polynucleotides, such as mRNA, or insertion of CAR polynucleotide into site of nuclease activity using homologous or non-homologous recombination.

Step 6. CAR-bearing immune effector cells are then cultured to expand their population.

Example 3—Method of Making Genome-Edited Tandem CAR-Bearing Immune Effector Cells In a variation of the protocol in the example above, a tCAR cell recognizing two antigens can be made. In Step 4, the two antigens can be deleted from the cell surface, or suppressed as described above, but electroporation with gRNA for each of the two targets and Cas9 mRNA. In Step 5, cells are then transduced with a CAR that recognizes two targets.

Example 4—Method of Making Genome-Edited Dual CAR-Bearing Immune Effector Cells

In a variation of the protocol in the example above, a dCAR cell targeting two antigens can be made. This variation would contain two separate CARs, each recognizing a different antigen.

Example 5—Method of Making and Testing a Genome-Edited CAR-T Cell with Suppressed Expression of Cytokine or Chemokine The following steps may be taken to provide a genome-edited CAR-T cell with suppressed expression and/or secretion of a specific cytokine or chemokine. This example describes the making of a CD19 targeting CAR-T which is deficient in expression of GM-CSF. As those of skill in the art will recognize, certain of the steps may be conducted sequentially or out of the order listed below, though perhaps leading to different efficiency.

Tumor is injected into SCID-Beige mice (3e6 Raji containing Luciferase) if performing in vivo CRS experiment. This should be completed 3 weeks prior to infusion of CAR-T into mice.

T Cell Activation (Day 0).

T cells are purified via leukapheresis chamber using a Miltenyi human PanT isolation kit, then resuspended in media. Cells are counted and the number of human T cell activation CD3/CD28 beads required to obtain 3:1 bead: cell ratio determined. Beads are washed 2× with T cell media, then cells diluted at 1.256 cells/mL in hXcyte media. Human T cell activation CD3/CD28 beads are added. Into each well of a 6-well plate are aliquoted 4 mL/well of 1.256 cell/mL solution. Cells are incubated at 37° C.

CRISPR (Day 2).

Target deletion may be accomplished by electroporating with Cas9 mRNA and gRNA against the target(s). Other techniques, however, could be used to suppress expression of the target. These include other genome editing techniques such as TALENs, RNA interference, and eliciting of internal binding of the antigen to prevent cell surface expression. Examples of gRNAs that may be used include those shown in Tables 8-10, as well as others known in the art.

| Sample ID | gRNA#1 | Cas9 | Nucleofection Buffer P3 |
|---|---|---|---|
| | 20 μg gGM-CSF | 15 μg Cas9 mRNA | 100 μl |

TABLE 9

Guide RNA sequences for use in reducing CRS

| Target gene | gRNA sequence |
|---|---|
| GM-CSF | 5' 2'OMe(U(ps)A(ps)C(ps))UCAGGUU CAGGAGACGCGUUUUAGAGCUAGAAAUAGCAA GUUAAAAUAAGGCUAGUCCGUUAUCAACUUGA AAAAGUGGCACCGAGUCGGUGC 2'OMe (U(ps)U(ps)U(ps)U_3' (SEQ ID NO: 50) |

RNA; (ps) indicate phosphorothioate.
Underlined bases denote target sequence.

TABLE 10

Additional guide RNA sequences for use in reducing the incidence of CRS

| Target Gene Symbol | Guide RNA Sequence | SEQ ID NO: | Location | Gene ID No. |
|---|---|---|---|---|
| A2M | GACAAAUCAAUCUACAAACC | 56 | chr12 | ENST00000318602.11 |
| A2M | GGUCCGCUUCUUAAAUUCUU | 57 | chr12 | ENST00000318602.11 |
| A2M | UCCUCAUUGGAUGAAGACUU | 58 | chr12 | ENST00000318602.11 |
| ACKR1 | AACUGAGAACUCAAGUCAGC | 59 | chr1 | ENST00000368122.2 |
| ACKR1 | GAAGGAAUCAUUCACACCAU | 60 | chr1 | ENST00000368122.2 |
| ACKR1 | ACACUGGUGAGGAUGAAGAA | 61 | chr1 | ENST00000368122.2 |
| ACKR2 | UCGGCAUCCUCAGUGGCGAG | 62 | chr3 | ENST00000422265.5 |
| ACKR2 | GCAUGAAGGCCACUUCAUCC | 63 | chr3 | ENST00000422265.5 |
| ACKR2 | AAAUCAGGCUAUAGAAGACU | 64 | chr3 | ENST00000422265.5 |
| ACKR3 | UAGAGCAGGACGCUUUUGUU | 65 | chr2 | ENST00000272928.3 |
| ACKR3 | CGGCAUGAUUGCCAACUCCG | 66 | chr2 | ENST00000272928.3 |
| ACKR3 | CCCACAGGUCGGCAAUGGCC | 67 | chr2 | ENST00000272928.3 |
| ACVR1 | UCUUUCCCUGCUCAUAAACC | 68 | chr2 | ENST00000263640.7 |
| ACVR1 | UCCUCACUGAGCAUCAACGA | 69 | chr2 | ENST00000263640.7 |
| ACVR1 | CUCUACAUGUGUGUGUGUGA | 70 | chr2 | ENST00000263640.7 |
| ACVR2B | CUACAACGCCAACUGGGAGC | 71 | chr3 | ENST00000352511.4 |
| ACVR2B | GCCAGAGCUGUUGCGCCAGG | 72 | chr3 | ENST00000352511.4 |
| ACVR2B | AUGACUUCAACUGCUACGAU | 73 | chr3 | ENST00000352511.4 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| ACVRL1 | AGACCCUGUGAAGCCGUCUC | 74 | chr12 | ENST00000388922.8 |
| ACVRL1 | GGCCUACCUGCCGGGGGGCC | 75 | chr12 | ENST00000388922.8 |
| ACVRL1 | GGGGCUGCGGGAACUUGCAC | 76 | chr12 | ENST00000388922.8 |
| ADIPOQ | GGGCUCAGGAUGCUGUUGCU | 77 | chr3 | ENST00000320741.6 |
| ADIPOQ | CGUGGUUUCCUGGUCAUGAC | 78 | chr3 | ENST00000320741.6 |
| ADIPOQ | GGGGGCCUGCACAGGUUGGA | 79 | chr3 | ENST00000320741.6 |
| AGER | ACGGACUCGGUAGUUGGACU | 80 | chr6 | ENST00000375076.8 |
| AGER | CUGUCGGGAUCCAGGAUGAG | 81 | chr6 | ENST00000375076.8 |
| AGER | UCCCCAGGGAGGAGGCCCCU | 82 | chr6 | ENST00000375076.8 |
| AGRN | CGGGGAAUGCUGUGCGGCUU | 83 | chr1 | ENST00000379370.6 |
| AGRN | GAAGAGCCCGUGCCCCAGCG | 84 | chr1 | ENST00000379370.6 |
| AGRN | GCAUUCGUUGCUGUAGGUGG | 85 | chr1 | ENST00000379370.6 |
| AHR | UUGAUUCCUUCAGCUGGGAU | 86 | chr7 | ENST00000242057.8 |
| AHR | GUAAAGCCAAUCCCAGCUGA | 87 | chr7 | ENST00000242057.8 |
| AHR | UUGACUUGAUUCCUUCAGCU | 88 | chr7 | ENST00000242057.8 |
| AHR | UUUGACUUGAUUCCUUCAGC | 89 | chr7 | ENST00000242057.8 |
| AIMP1 | AACCAAUUCGAAGAUCCAGA | 90 | chr4 | ENST00000358008.7 |
| AIMP1 | UAUGUGGAAGAAGUAGAUGU | 91 | chr4 | ENST00000358008.7 |
| AIMP1 | CAAGAGGAACAUGAUUCACC | 92 | chr4 | ENST00000358008.7 |
| AREG | GGUCCAAUCCAGCAGCAUAA | 93 | chr4 | ENST00000395748.7 |
| AREG | CCACAGUGCUGAUGGAUUUG | 94 | chr4 | ENST00000395748.7 |
| AREG | AGAAGGCAUUUCACUCACAG | 95 | chr4 | ENST00000395748.7 |
| BCL6 | CUGUAAAGAUGCUAUAGAAC | 96 | chr3 | ENST00000406870.6 |
| BCL6 | CACUAAGGUUGCAUUUCAAC | 97 | chr3 | ENST00000406870.6 |
| BCL6 | GAUCUAGAUUGAUCACACUA | 98 | chr3 | ENST00000406870.6 |
| BCL6 | AAUCCCUCAGGGUUGAUCUC | 99 | chr3 | ENST00000406870.6 |
| BMP1 | CAGCGGCAGGCGGGCCACGC | 100 | chr8 | ENST00000306385.9 |
| BMP1 | GGCCGACUACACCUAUGACC | 101 | chr8 | ENST00000306385.9 |
| BMP1 | GGCGCUCACCCGCCUUGCAG | 102 | chr8 | ENST00000306385.9 |
| BMP10 | GAAACUCAUCCUUCAUGCUC | 103 | chr2 | ENST00000295379.1 |
| BMP10 | AGGGACAUAUCUUCUUCCAG | 104 | chr2 | ENST00000295379.1 |
| BMP10 | CAGAAACCAAGUAAGCUGCC | 105 | chr2 | ENST00000295379.1 |
| BMP15 | CGUGCUUUUCAUGGAACACA | 106 | chrX | ENST00000252677.3 |
| BMP15 | CCCUACUUUGCCCCUGAUUG | 107 | chrX | ENST00000252677.3 |
| BMP15 | AGUGAAUGCCCUAGGAGCCG | 108 | chrX | ENST00000252677.3 |
| BMP2 | CGCAGGUCGACCAUGGUGGC | 109 | chr20 | ENST00000378827.4 |

TABLE 10-continued

Additional guide RNA sequences for use in
reducing the incidence of CRS

| Target Gene Symbol | Guide RNA Sequence | SEQ ID NO: | Location | Gene ID No. |
|---|---|---|---|---|
| BMP2 | GGGCCGCAGGAAGUUCGCGG | 110 | chr20 | ENST00000378827.4 |
| BMP2 | GCCGCAACUCGAACUCGCUC | 111 | chr20 | ENST00000378827.4 |
| BMP3 | AGGCUGCUCUUUCUGUGGCU | 112 | chr4 | ENST00000282701.2 |
| BMP3 | GGCACAGCUUUGCGGAGCUC | 113 | chr4 | ENST00000282701.2 |
| BMP3 | CGAGCUGCAGCCGCAAGACA | 114 | chr4 | ENST00000282701.2 |
| BMP4 | UUCGUGGUGGAAGCUCCUCA | 115 | chr14 | ENST00000245451.8 |
| BMP4 | GAAGAGCAGAUCCACAGCAC | 116 | chr14 | ENST00000245451.8 |
| BMP4 | CACUCUUGCUAGGCUGCGGG | 117 | chr14 | ENST00000245451.8 |
| BMP5 | ACUGAGUACUCCGACUCUUC | 118 | chr6 | ENST00000370830.3 |
| BMP5 | AGACCCAGACCAUUUUCACC | 119 | chr6 | ENST00000370830.3 |
| BMP5 | CGAAAGACGGGAAAUACAAA | 120 | chr6 | ENST00000370830.3 |
| BMP6 | GAUGCAGAAGGAGAUCUUGU | 121 | chr6 | ENST00000283147.6 |
| BMP6 | GGCUGUUGGAGGCCGUGCAG | 122 | chr6 | ENST00000283147.6 |
| BMP6 | CCUCGCGGAGAGCCCCCUCC | 123 | chr6 | ENST00000283147.6 |
| BMP7 | UCUCAUUGUCGAAGCGUUCC | 124 | chr20 | ENST00000395863.7 |
| BMP7 | GCCGUGACAGCUUCCCCUUC | 125 | chr20 | ENST00000395863.7 |
| BMP7 | UCUUCCAGUGGAACAUGACA | 126 | chr20 | ENST00000395863.7 |
| BMP8A | CCAGAAGCCAGAGCGGUCCG | 127 | chr1 | ENST00000331593.5 |
| BMP8A | UGGCGGUGCUCGGGCUACCC | 128 | chr1 | ENST00000331593.5 |
| BMP8A | UGGCGGUGCUCGGGCUACCC | 129 | chr1 | ENST00000331593.5 |
| BMP8B | CGGUGCUCGGGCUGCCUGGG | 130 | chr1 | ENST00000372827.7 |
| BMP8B | CCCAGGAGCCAGAGCGGGCC | 131 | chr1 | ENST00000372827.7 |
| BMP8B | CCCAGGAGCCAGAGCGGGCC | 132 | chr1 | ENST00000372827.7 |
| BMPR2 | CACUUGCAGCUGAUUGGCCG | 133 | chr2 | ENST00000374580.8 |
| BMPR2 | UUUCGUUGAUAAAAUUCUGA | 134 | chr2 | ENST00000374580.8 |
| BMPR2 | CUCAUCUCCAACUAUAAAGC | 135 | chr2 | ENST00000374580.8 |
| C10orf99 | GGAAAGGACUAGAAGCCUCA | 136 | chr10 | ENST00000372126.3 |
| C10orf99 | CCUACCUUCUGUGGAGAAGA | 137 | chr10 | ENST00000372126.3 |
| C10orf99 | CUCUGAUCAGGAUUUGUUGG | 138 | chr10 | ENST00000372126.3 |
| C1QTNF4 | CCAUCUCCGACGUGCCCUCC | 139 | chr11 | ENST00000302514.3 |
| C1QTNF4 | CAGCUCAGAGGAUCCCGGGC | 140 | chr11 | ENST00000302514.3 |
| C1QTNF4 | CCCAGCAGGCCCAGCAGAAG | 141 | chr11 | ENST00000302514.3 |
| C5* | UCCAGCACCGUCACUCCAGA | 142 | chr9 | ENST00000223642.2 |
| C5* | ACACGUGUUACACUUUUGCU | 143 | chr9 | ENST00000223642.2 |
| C5* | GAUUCGCUUGACCAGUUGGU | 144 | chr9 | ENST00000223642.2 |
| CCL1* | AGAAACGUGGUCAGCCACUC | 145 | chr17 | ENST00000225842.3 |
| CCL1* | CUCUUGCUGUCCACAUCUUC | 146 | chr17 | ENST00000225842.3 |

TABLE 10-continued

Additional guide RNA sequences for use in
reducing the incidence of CRS

| Target Gene Symbol | Guide RNA Sequence | SEQ ID NO: | Location | Gene ID No. |
| --- | --- | --- | --- | --- |
| CCL1* | GCAGAUCAUCACCACAGCCC | 147 | chr17 | ENST00000225842.3 |
| CCL11 | AGGUCUCCGCAGCACUUCUG | 148 | chr17 | ENST00000305869.3 |
| CCL11 | CUGGCCCAGCGAGCCCCUGG | 149 | chr17 | ENST00000305869.3 |
| CCL11 | UAACCACCUCCAGAGCUACU | 150 | chr17 | ENST00000305869.3 |
| CCL13* | AUGUGAAGCAGCAAGUAGAU | 151 | chr17 | ENST00000225844.6 |
| CCL13* | CUUCUGGGGACACCUGCUGG | 152 | chr17 | ENST00000225844.6 |
| CCL13* | AACUUUGGAUGGGGAAUGU | 153 | chr17 | ENST00000225844.6 |
| CCL14 | CAGGAGUGAGGUUGGGGCUC | 154 | chr17 | ENST00000618404.4 |
| CCL14 | GGCAUUGCACUCACGUGAGG | 155 | chr17 | ENST00000618404.4 |
| CCL14 | CCACAGCAUGAAGAUCUCCG | 156 | chr17 | ENST00000618404.4 |
| CCL15* | UCCCAGAGCUUGAGUUACCA | 157 | chr17 | ENST00000617897.1 |
| CCL15* | CACCAUUUGUGAACUGGGCC | 158 | chr17 | ENST00000617897.1 |
| CCL15* | CACCAUUUGUGAACUGGGCC | 159 | chr17 | ENST00000617897.1 |
| CCL16 | GGACGUGCUUACAUGAUUGC | 160 | chr17 | ENST00000611905.1 |
| CCL16 | GUUGCCAAGGAGACUAGUGG | 161 | chr17 | ENST00000611905.1 |
| CCL16 | UCCUUCAGAAGUUCCUGAGU | 162 | chr17 | ENST00000611905.1 |
| CCL17 | GCUCCUCUCCCUGCAGCUCG | 163 | chr16 | ENST00000219244.8 |
| CCL17 | UGGCUCCCUUGAAGUACUCC | 164 | chr16 | ENST00000219244.8 |
| CCL17 | UGGAGCAGUCCUCAGAUGUC | 165 | chr16 | ENST00000219244.8 |
| CCL18 | GAGGCAGCAGAGCUCUUUGU | 166 | chr17 | ENST00000616054.1 |
| CCL18 | UGGCUUGGGGCACUGGGGGC | 167 | chr17 | ENST00000616054.1 |
| CCL18 | CCAUCCUCCCUCCCGAGGGG | 168 | chr17 | ENST00000616054.1 |
| CCL19 | CCCACAACUCACACUACAGC | 169 | chr9 | ENST00000311925.6 |
| CCL19 | AAGUUCCUCACGAUGUACCC | 170 | chr9 | ENST00000311925.6 |
| CCL19 | CAUUGGUGCCACUCAGAGUU | 171 | chr9 | ENST00000311925.6 |
| CCL2 | GUUAUAACAGCAGGUGACUG | 172 | chr17 | ENST00000225831.4 |
| CCL2 | UUCUUUGGGACACUUGCUGC | 173 | chr17 | ENST00000225831.4 |
| CCL2 | GGCUUGUCCCUUGCUCCACA | 174 | chr17 | ENST00000225831.4 |
| CCL20 | CAAACUCUUGGUACAGCACA | 175 | chr2 | ENST00000358813.4 |
| CCL20 | CACCUCUGCGGCGAAUCAGA | 176 | chr2 | ENST00000358813.4 |
| CCL20 | CAGUUGAGCUCAAGGCUAAA | 177 | chr2 | ENST00000358813.4 |
| CCL21 | CCCUGCAGGCAGUGAUGGAG | 178 | chr9 | ENST00000259607.6 |
| CCL21 | CCUCCCUGCCUUGGUACCUU | 179 | chr9 | ENST00000259607.6 |
| CCL21 | GGCUCUGAGCCUCCUUAUCC | 180 | chr9 | ENST00000259607.6 |
| CCL22 | ACCCCUCCCCUAGGCCCCUA | 181 | chr16 | ENST00000219235.4 |
| CCL22 | GACGGUAACGGACGUAAUCA | 182 | chr16 | ENST00000219235.4 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| CCL22 | AGGCCUCGGGCAGGAGUCUG | 183 | chr16 | ENST00000219235.4 |
| CCL23* | UCGUUUCAAAGUAACUCUCC | 184 | chr17 | ENST00000615050.1 |
| CCL23* | AGCAGUCAGCACUAGUAGCA | 185 | chr17 | ENST00000615050.1 |
| CCL23* | GUGCUCUGGAGGAGAAAGAU | 186 | chr17 | ENST00000615050.1 |
| CCL24 | CCUCAAGGCAGGAGUGAUGU | 187 | chr7 | ENST00000222902.6 |
| CCL24 | GAGAAUUCCUGAGAACCGAG | 188 | chr7 | ENST00000222902.6 |
| CCL24 | CUCUCCUCUUCUAGGCUCUG | 189 | chr7 | ENST00000222902.6 |
| CCL25 | UGUGGUUGCAGGUGUCUUUG | 190 | chr19 | ENST00000390669.7 |
| CCL25 | GGGCUGUGCUCCGGCGCGCC | 191 | chr19 | ENST00000390669.7 |
| CCL25 | GGCCCCACUCACAUCGCAGC | 192 | chr19 | ENST00000390669.7 |
| CCL26 | CCAUCCUGUUGCAUGACUGA | 193 | chr7 | ENST00000005180.8 |
| CCL26 | CCAGUAACAGCUGCUCCCAG | 194 | chr7 | ENST00000005180.8 |
| CCL26 | GUAUUGGAAGCAGCAGGUCU | 195 | chr7 | ENST00000005180.8 |
| CCL27 | GAGCUCACACGAAAGCCUGG | 196 | chr9 | ENST00000259631.4 |
| CCL27 | ACUGAGGAAGGUCAUCCAGG | 197 | chr9 | ENST00000259631.4 |
| CCL27 | AGGCAGUGCUGGGUGGCAGU | 198 | chr9 | ENST00000259631.4 |
| CCL28 | AAUCCUUCCAGCACAGAUUU | 199 | chr5 | ENST00000361115.4 |
| CCL28 | GUGCCCCACUCACCUUCUG | 200 | chr5 | ENST00000361115.4 |
| CCL28 | CAGGCAGGAAUGCAGCAGAG | 201 | chr5 | ENST00000361115.4 |
| CCL3 | GCCACAAGAAAAGAUUGAUG | 202 | chr17 | ENST00000613922.1 |
| CCL3 | ACUCACGUGAUGCAGAGAAC | 203 | chr17 | ENST00000613922.1 |
| CCL3 | UCACCUGCUCAGAAUCAUGC | 204 | chr17 | ENST00000613922.1 |
| CCL4* | UGAGAGCGCUGGAGAGCAGA | 205 | chr17 | ENST00000615863.1 |
| CCL4* | UGAGAGCGCUGGAGAGCAGA | 206 | chr17 | ENST00000615863.1 |
| CCL4* | UGAGAGCGCUGGAGAGCAGA | 207 | chr17 | ENST00000615863.1 |
| CCL5 | GACUCACACGACUGCUGGGU | 208 | chr17 | ENST00000603197.5 |
| CCL5 | UGAUGUGGGCACGGGGCAGU | 209 | chr17 | ENST00000603197.5 |
| CCL5 | CUUUCCUCUUCCAGAUUCCU | 210 | chr17 | ENST00000603197.5 |
| CCL7 | AUUGAUAAAUCUGUAGCAGC | 211 | chr17 | ENST00000378569.2 |
| CCL7 | CCACAUACAUUACAGCUUCC | 212 | chr17 | ENST00000378569.2 |
| CCL7 | CUAGUCCUAUUCCCUGCCCA | 213 | chr17 | ENST00000378569.2 |
| CCL8* | AAAGCAGCAGGUGAUUGGAA | 214 | chr17 | ENST00000394620.1 |
| CCL8* | CACCAACAUCCAAUGUCCCA | 215 | chr17 | ENST00000394620.1 |
| CCL8* | CCCCCAUUCAAAAGUUCUGA | 216 | chr17 | ENST00000394620.1 |
| CCR1 | CCUGGUUGGAAACAUCCUGG | 217 | chr3 | ENST00000296140.3 |
| CCR1 | AGGCCCUCUCGUUCACCUUC | 218 | chr3 | ENST00000296140.3 |
| CCR1 | UCAUAGUCCUCUGUGGUGUU | 219 | chr3 | ENST00000296140.3 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| CCR2 | GAUAAACCGAGAACGAGAUG | 220 | chr3 | ENST00000445132.2 |
| CCR2 | ACCUUUUUGAUUAUGAUUA | 221 | chr3 | ENST00000445132.2 |
| CCR2 | GUAGAGCGGAGGCAGGAGUU | 222 | chr3 | ENST00000445132.2 |
| CCR3 | CUAGAUACAGUUGAGACCUU | 223 | chr3 | ENST00000357422.2 |
| CCR3 | UAUCAGCUUUUUCACAGAGC | 224 | chr3 | ENST00000357422.2 |
| CCR3 | GGUGUUCACUGUGGGCCUCU | 225 | chr3 | ENST00000357422.2 |
| CCR5 | UUUUGCAGUUUAUCAGGAUG | 226 | chr3 | ENST00000292303.4 |
| CCR5 | AAAACAGGUCAGAGAUGGCC | 227 | chr3 | ENST00000292303.4 |
| CCR5 | UGUAUUCCAAAGUCCCACU | 228 | chr3 | ENST00000292303.4 |
| CCR6 | UUGUUCUUACUCUCCCAUUC | 229 | chr6 | ENST00000341935.9 |
| CCR6 | GCCUUUUAGCAACUUGCACG | 230 | chr6 | ENST00000341935.9 |
| CCR6 | CCGGUACAUCGCCAUUGUAC | 231 | chr6 | ENST00000341935.9 |
| CCR7 | GGCCGCGCUGUAGGCCCAGA | 232 | chr17 | ENST00000246657.2 |
| CCR7 | GAGCAGGUAGGUAUCGGUCA | 233 | chr17 | ENST00000246657.2 |
| CCR7 | UAGGCCCACGAAACAAAUGA | 234 | chr17 | ENST00000246657.2 |
| CD109 | UCCGGGCCUGAUGAUCCCUG | 235 | chr6 | ENST00000287097.5 |
| CD109 | GCCUUCACAGUCACCUGUGA | 236 | chr6 | ENST00000287097.5 |
| CD109 | CAAAGACUCCUUCUGCUUCC | 237 | chr6 | ENST00000287097.5 |
| CD27** | CCUUCACGAGGAAUGUUCCU | 238 | chr12 | ENST00000266557.3 |
| CD27** | UCCUUCACGAGGAAUGUUCC | 239 | chr12 | ENST00000266557.3 |
| CD27** | GCUGGUCACAGUCCUUCACG | 240 | chr12 | ENST00000266557.3 |
| CD27** | ACUGAGCAGCCUUUCUAUGC | 241 | chr12 | ENST00000266557.3 |
| CD28*** | CACCAAAAUCUUGUUUCCUG | 242 | ch2 | ENST00000458610.6 |
| CD28*** | UCACCAAAAUCUUGUUUCCU | 243 | ch2 | ENST00000458610.6 |
| CD28*** | UUGUCGUACGCUACAAGCAU | 244 | ch2 | ENST00000458610.6 |
| CD28*** | AUUGUCGUACGCUACAAGCA | 245 | ch2 | ENST00000458610.6 |
| CD36 | CAAGAAAAAUGGGCUGUGAC | 246 | chr7 | ENST00000309881.11 |
| CD36 | GGUGCUGUCCUGGCUGUGUU | 247 | chr7 | ENST00000309881.11 |
| CD36 | UAUCCAGAAGACAAUUAAAA | 248 | chr7 | ENST00000309881.11 |
| CD4** | AGUGCAAUGUAGGAGUCCAA | 249 | chr12 | ENST00000011653.8 |
| CD4** | CUGGAGCUCCAGCUGAGACA | 250 | chr12 | ENST00000011653.8 |
| CD4** | UUUUGAACUCCACCUUCUUC | 251 | chr12 | ENST00000011653.8 |
| CD40LG** | CAAAAUAGAUAGAAGAUGAA | 252 | chrX | ENST00000370629.6 |
| CD40LG** | ACGAUACAGAGAUGCAACAC | 253 | chrX | ENST00000370629.6 |
| CD40LG** | CCAGUUUGAAGGCUUUGUGA | 254 | chrX | ENST00000370629.6 |
| CD70 | AGCGCUGGAUGCACACCACG | 255 | chr19 | ENST00000245903.3 |

TABLE 10-continued

Additional guide RNA sequences for use in
reducing the incidence of CRS

| Target Gene Symbol | Guide RNA Sequence | SEQ ID NO: | Location | Gene ID No. |
|---|---|---|---|---|
| CD70 | AGCCCGCAGGACGCACCCAU | 256 | chr19 | ENST00000245903.3 |
| CD70 | CGCCGCGGCGAUGCCGGAGG | 257 | chr19 | ENST00000245903.3 |
| CD74 | UGCUCACACAUACCUCUCCG | 258 | chr5 | ENST00000009530.11 |
| CD74 | UGUUGGAGAUAAGGUCGCGC | 259 | chr5 | ENST00000009530.11 |
| CD74 | AGAUGCACAGGAGGAGAAGC | 260 | chr5 | ENST00000009530.11 |
| CD8A** | CCGGAACUGGCUCGGCCUGG | 261 | ch2 | ENST00000409511.6 |
| CD8A** | CACCCGGAACUGGCUCGGCC | 262 | ch2 | ENST00000409511.6 |
| CD8A** | GGCGACACCCGGAACUGGCU | 263 | ch2 | ENST00000409511.6 |
| CD8A** | CGCCAGGCCGAGCCAGUUCC | 264 | ch2 | ENST00000409511.6 |
| CER1 | GGCACUGCGACAAACAGAUC | 265 | chr9 | ENST00000380911.3 |
| CER1 | AAAGAGAACUCUGAUUCUGG | 266 | chr9 | ENST00000380911.3 |
| CER1 | CUGCUGGUACUCCUGCCUCU | 267 | chr9 | ENST00000380911.3 |
| CHRD | GCCGGCGGGGCCGGGAGGCU | 268 | chr3 | ENST00000204604.5 |
| CHRD | UCCCGGCCGGCCCGCGGCGC | 269 | chr3 | ENST00000204604.5 |
| CHRD | CUGCCCGUUCGGGGAGCGGC | 270 | chr3 | ENST00000204604.5 |
| CKLF | GUGAUAACAAUAUAUGGUUC | 271 | chr16 | ENST00000264001.8 |
| CKLF | GACUUGAUCGAUUAAUGAAG | 272 | chr16 | ENST00000264001.8 |
| CKLF | GUAGGAAAAGUAAAAUUUA | 273 | chr16 | ENST00000264001.8 |
| CLCF1 | CAUAGGUCCCAGCCAAGCUG | 274 | chr11 | ENST00000312438.7 |
| CLCF1 | CAUAGGUUUUCUGGAUGGAG | 275 | chr11 | ENST00000312438.7 |
| CLCF1 | GGUGCCAGAGCACCGUGCAC | 276 | chr11 | ENST00000312438.7 |
| CMTM1 | GACUCAGGUUUGGCUGUUUC | 277 | chr16 | ENST00000379500.6 |
| CMTM1 | UACGCUGCCGCUACUUGCCA | 278 | chr16 | ENST00000379500.6 |
| CMTM1 | UGCGGGGUGCUUCCGGGGUG | 279 | chr16 | ENST00000379500.6 |
| CMTM2 | CGAGUCAGUCAUGGCACCUA | 280 | chr16 | ENST00000268595.2 |
| CMTM2 | UCCACCCGGGGCCAAACCCG | 281 | chr16 | ENST00000268595.2 |
| CMTM2 | AAAGGCGGUGCAGGACCAUA | 282 | chr16 | ENST00000268595.2 |
| CMTM3 | CCGGACCCCGAGCCUGCCGG | 283 | chr16 | ENST00000361909.8 |
| CMTM3 | GGAAAGCCCGCGCCGGCAGC | 284 | chr16 | ENST00000361909.8 |
| CMTM3 | UCCCGCCGCACUCACCGACU | 285 | chr16 | ENST00000361909.8 |
| CMTM4 | CCGCCCGGCACCUACCACUU | 286 | chr16 | ENST00000394106.6 |
| CMTM4 | GGUAGUCGGGGUCGCAGCGC | 287 | chr16 | ENST00000394106.6 |
| CMTM4 | GCUGCUGGCGCCCGAGAUCA | 288 | chr16 | ENST00000394106.6 |
| CMTM5 | GCUCAGUGCUCGAGAUCGCC | 289 | chr14 | ENST00000359320.7 |
| CMTM5 | CCAGGGCUUCGCGGUGGACA | 290 | chr14 | ENST00000359320.7 |
| CMTM5 | UUACCAGCUCGGUUUCCAGC | 291 | chr14 | ENST00000359320.7 |
| CMTM6 | UUGAGAACGCGCCGGAGCAA | 292 | chr3 | ENST00000205636.3 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| CMTM6 | CGCUCCGGGGCCUCUGGCG | 293 | chr3 | ENST00000205636.3 |
| CMTM6 | CGGCCCGAGGCGAUGGAGAA | 294 | chr3 | ENST00000205636.3 |
| CMTM7 | GGAGCUCCGCACACAGAUGA | 295 | chr3 | ENST00000334983.9 |
| CMTM7 | AAUGAUCCUCGCCUUUUACC | 296 | chr3 | ENST00000334983.9 |
| CMTM7 | CGACAGGGGCCAGCUGAUAC | 297 | chr3 | ENST00000334983.9 |
| CMTM8 | GUGUGCGAGCGGGCGCGCUG | 298 | chr3 | ENST00000307526.3 |
| CMTM8 | CAGCAGCUUCGCCUACGACC | 299 | chr3 | ENST00000307526.3 |
| CMTM8 | CCCGUCGGCACUCACGAUCU | 300 | chr3 | ENST00000307526.3 |
| CNTF | AUCAACCUGGACUCUGCGGA | 301 | chr11 | ENST00000361987.5 |
| CNTF | GGAAGGUACGAUAAGCUUGA | 302 | chr11 | ENST00000361987.5 |
| CNTF | GUGCAUUUUACCCCAACCGA | 303 | chr11 | ENST00000361987.5 |
| CNTFR | CCAGCUGAGAGCCGUUGAGC | 304 | chr9 | ENST00000351266.8 |
| CNTFR | GGGAUGCUGCGGUGACGUGG | 305 | chr9 | ENST00000351266.8 |
| CNTFR | CAGGCGCUCGUACUGCACAU | 306 | chr9 | ENST00000351266.8 |
| COPS5 | UAGUCCAGGGCUUCGCCGCC | 307 | chr8 | ENST00000357849.8 |
| COPS5 | CUGAGCUUCCUGCAUGUUGU | 308 | chr8 | ENST00000357849.8 |
| COPS5 | CCUCGGCGAUGGCGGCGUCC | 309 | chr8 | ENST00000357849.8 |
| CRLF1 | CCAGCGUGAGUACAUCGGAG | 310 | chr19 | ENST00000392386.7 |
| CRLF1 | CAUAGGGCGUAAAGAGAGCC | 311 | chr19 | ENST00000392386.7 |
| CRLF1 | ACUCCUCACAUGUGUUGUCC | 312 | chr19 | ENST00000392386.7 |
| CSF1* | GCCUUCUUAAGGUAGCACAC | 313 | chr1 | ENST00000329608.10 |
| CSF1* | GGUGUUAUCUCUGAAGCGCA | 314 | chr1 | ENST00000329608.10 |
| CSF1* | GUCAUGCUCUUCAUAAUCCU | 315 | chr1 | ENST00000329608.10 |
| CSF1R | CACCUUUCUGCACUUUCAGC | 316 | chr5 | ENST00000286301.7 |
| CSF1R | CAAUGCAGUGCCCUGAUGGG | 317 | chr5 | ENST00000286301.7 |
| CSF1R | CCAGGGCGAGAAGGAGUAGU | 318 | chr5 | ENST00000286301.7 |
| CSF2* | CCACAGUGCCCAAGAGCAGC | 319 | chr5 | ENST00000296871.3 |
| CSF2* | CAGGGCUGCGUGCUGGGGCU | 320 | chr5 | ENST00000296871.3 |
| CSF2* | UAGAGACACUGCUGCUGAGA | 321 | chr5 | ENST00000296871.3 |
| CSF3 | UGUGCCACAGCAGCAGCUGC | 322 | chr17 | ENST00000225474.6 |
| CSF3 | GAAGCUCUGGGGCAGGGAGC | 323 | chr17 | ENST00000225474.6 |
| CSF3 | GGGCGAUGGCGCAGCGCUCC | 324 | chr17 | ENST00000225474.6 |
| CSF3R | GCAAUAGCAACAAGACCUGG | 325 | chr1 | ENST00000361632.8 |
| CSF3R | AUAGCCCUGAGGCCAUGGAU | 326 | chr1 | ENST00000361632.8 |
| CSF3R | GCAUGGAGUCUGGUCAGAGC | 327 | chr1 | ENST00000361632.8 |
| CTF1 | UCUCCGCAGGUGCAGCUCCA | 328 | chr16 | ENST00000279804.2 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| CTF1 | CCGGCCACCGGCAGCCGCGG | 329 | chr16 | ENST00000279804.2 |
| CTF1 | AGCCGCAGCCGCUCGUGCAC | 330 | chr16 | ENST00000279804.2 |
| CX3CL1 | GUGCCGACCCGAAGGAGCAA | 331 | chr16 | ENST00000006053.6 |
| CX3CL1 | CUUCGAGAAGCAGAUCGGCG | 332 | chr16 | ENST00000006053.6 |
| CX3CL1 | CGCCUGUGGCUUCGGGCUCC | 333 | chr16 | ENST00000006053.6 |
| CX3CR1** | CUACCAACAAAUUUCCCACC | 334 | chr3 | ENST00000399220.2 |
| CX3CR1** | UUGGGGACAUCGUGGUCUUU | 335 | chr3 | ENST00000399220.2 |
| CX3CR1** | AAGUUUUCUGUCACUGAUUC | 336 | chr3 | ENST00000399220.2 |
| CXCL1 | GGAGAGAGCAGCGCGGGCCA | 337 | chr4 | ENST00000395761.3 |
| CXCL1 | CUGGCCGGCGCGCAGCAGGU | 338 | chr4 | ENST00000395761.3 |
| CXCL1 | GUGCCUACCCCAGCCGCGUC | 339 | chr4 | ENST00000395761.3 |
| CXCL10 | UACAGUAUAUAAUUACAACC | 340 | chr4 | ENST00000306602.2 |
| CXCL10 | CGUGGACAAAAUUGGCUUGC | 341 | chr4 | ENST00000306602.2 |
| CXCL10 | UUGAUUACUAAUGCUGAUGC | 342 | chr4 | ENST00000306602.2 |
| CXCL11 | GCUGAAGAUGACAAUGGUGC | 343 | chr4 | ENST00000306621.7 |
| CXCL11 | GUUGUUACUUGGGUACAUUA | 344 | chr4 | ENST00000306621.7 |
| CXCL11 | AGCGUCCUCUUUUGAACAUG | 345 | chr4 | ENST00000306621.7 |
| CXCL12 | CUACACCUUUAAUAAGACUC | 346 | chr10 | ENST00000343575.10 |
| CXCL12 | UCAAGACUUACACAAUCUGA | 347 | chr10 | ENST00000343575.10 |
| CXCL12 | UGACGUUGGCUCUGGCAACA | 348 | chr10 | ENST00000343575.10 |
| CXCL13 | AGGUCUAUUACACAAGCUUG | 349 | chr4 | ENST00000286758.4 |
| CXCL13 | UUCGAUCAAUGAAGCGUCUA | 350 | chr4 | ENST00000286758.4 |
| CXCL13 | ACUUACAUGAUUUCUUUUCU | 351 | chr4 | ENST00000286758.4 |
| CXCL14 | AAUUGGCGCUUGGGUUCCCC | 352 | chr5 | ENST00000337225.5 |
| CXCL14 | CUGUACACCGCGCUGUGGA | 353 | chr5 | ENST00000337225.5 |
| CXCL14 | GAGGGGCGCGGCGUGGGAGC | 354 | chr5 | ENST00000337225.5 |
| CXCL16 | GCGCUGAGUGGACUGCAAGG | 355 | chr17 | ENST00000293778.10 |
| CXCL16 | UACCAGCCCCCCAAUUUCUC | 356 | chr17 | ENST00000293778.10 |
| CXCL16 | AAUGUGGACAUGCUUACUCG | 357 | chr17 | ENST00000293778.10 |
| CXCL17 | AUUGGUCUCAGAGGGGCCCA | 358 | chr19 | ENST00000601181.5 |
| CXCL17 | GACCUUUGCACUCACAUUCU | 359 | chr19 | ENST00000601181.5 |
| CXCL17 | CUUCCGACAGGGGUCGCCAG | 360 | chr19 | ENST00000601181.5 |
| CXCL2 | GCAGUGGCAGCGGCAGCGAU | 361 | chr4 | ENST00000508487.2 |
| CXCL2 | UUCUUCCCUAGGAGCGCCCC | 362 | chr4 | ENST00000508487.2 |
| CXCL2 | UUCUUCCCUAGGAGCGCCCC | 363 | chr4 | ENST00000508487.2 |
| CXCL3* | UGGCAGCGGAAGCGCGGGGC | 364 | chr4 | ENST00000296026.4 |
| CXCL3* | GGGACCUUACAUUCACACUU | 365 | chr4 | ENST00000296026.4 |

TABLE 10-continued

Additional guide RNA sequences for use in
reducing the incidence of CRS

| Target Gene Symbol | Guide RNA Sequence | SEQ ID NO: | Location | Gene ID No. |
| --- | --- | --- | --- | --- |
| CXCL3* | GGGACCUUACAUUCACACUU | 366 | chr4 | ENST00000296026.4 |
| CXCL5 | CCCUUUAUAGGGCAGGUUGC | 367 | chr4 | ENST00000296027.4 |
| CXCL5 | GCGCCAUGCGCUCUCACCGC | 368 | chr4 | ENST00000296027.4 |
| CXCL5 | GAGCUCCUUGUGCGCGCUGU | 369 | chr4 | ENST00000296027.4 |
| CXCL6* | GCCCGAAGGACCCGGGACAC | 370 | chr4 | ENST00000226317.9 |
| CXCL6* | GGGGCCCCGGCGGCGUCAGC | 371 | chr4 | ENST00000226317.9 |
| CXCL6* | UUUUUAUAGGGCAGGUUGCU | 372 | chr4 | ENST00000226317.9 |
| CXCL8 | CAACAGGUGCAGUUUUGCCA | 373 | chr4 | ENST00000307407.7 |
| CXCL8 | AAAUUUGGGGUGGAAAGGUU | 374 | chr4 | ENST00000307407.7 |
| CXCL8 | UACUUACAUAAUUUCUGUGU | 375 | chr4 | ENST00000307407.7 |
| CXCL9* | UUUCAAUUUCUCGCAGGAA | 376 | chr4 | ENST00000264888.5 |
| CXCL9* | AUUGUAGGUGGAUAGUCCCU | 377 | chr4 | ENST00000264888.5 |
| CXCL9* | GGAACCCCAGUAGUGAGAAA | 378 | chr4 | ENST00000264888.5 |
| CXCR1 | GAUGGUAAGCCUGGCGGAAA | 379 | chr2 | ENST00000295683.2 |
| CXCR1 | UUGGUCAAGUUUGUUUGUCU | 380 | chr2 | ENST00000295683.2 |
| CXCR1 | CUACAGUGGCAUCCUGCUGU | 381 | chr2 | ENST00000295683.2 |
| CXCR2 | GUGACAGCUUUGAAGAUUUC | 382 | chr2 | ENST00000318507.6 |
| CXCR2 | AUCUAGUAGAAAAGGGGCA | 383 | chr2 | ENST00000318507.6 |
| CXCR2 | UGUGGUCAUUAUCUAUGCCC | 384 | chr2 | ENST00000318507.6 |
| CXCR3^ | GCAGAAAGAGGAGGCUGUAG | 385 | chrX | ENST00000373693.3 |
| CXCR3^ | UACCUCCCCGCCCUGCCCAC | 386 | chrX | ENST00000373693.3 |
| CXCR3^ | AAGAGCUGAAGUUCUCCAGG | 387 | chrX | ENST00000373693.3 |
| CXCR4^ | CCCAAAGUACCAGUUUGCCA | 388 | chr2 | ENST00000409817.1 |
| CXCR4^ | AGAGGAGGUCGGCCACUGAC | 389 | chr2 | ENST00000409817.1 |
| CXCR4^ | UGGAUUGGUCAUCCUGGUCA | 390 | chr2 | ENST00000409817.1 |
| CXCR6** | GGAAGUCUUGAUGCUCCUCC | 391 | chr3 | ENST00000304552.4 |
| CXCR6** | GGUGUUUGUCUGUGGUCUGG | 392 | chr3 | ENST00000304552.4 |
| CXCR6** | CCGUCAGGCUCUGCAACUUA | 393 | chr3 | ENST00000304552.4 |
| EBI3 | CACCCUGUGCAGGCUCGGCA | 394 | chr19 | ENST00000221847.5 |
| EBI3 | GGAUGUCCAGCUGUUCUCCA | 395 | chr19 | ENST00000221847.5 |
| EBI3 | AGCUGCUGCUGGAGCCCCAG | 396 | chr19 | ENST00000221847.5 |
| EDN1 | UUUCUCUCCCCAGCAGUCUU | 397 | chr6 | ENST00000379375.5 |
| EDN1 | CCACUCCCAGUCCACCCUGG | 398 | chr6 | ENST00000379375.5 |
| EDN1 | UCUGCCACCUGGACAUCAUU | 399 | chr6 | ENST00000379375.5 |
| ELANE | CACAAUCUCCGAGGCCAGCG | 400 | chr19 | ENST00000263621.1 |
| ELANE | GUGUCCCUGCAGCUGCGCGG | 401 | chr19 | ENST00000263621.1 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| ELANE | GCGGCCGACAUGACGAAGUU | 402 | chr19 | ENST00000263621.1 |
| ENG | CCGGGCCACUCGGCCGGGUA | 403 | chr9 | ENST00000344849.4 |
| ENG | CGCCUUCCAAGUGGCAGCCC | 404 | chr9 | ENST00000344849.4 |
| ENG | CGUGCGGCCCAUGUCCUGGC | 405 | chr9 | ENST00000344849.4 |
| EPO | CUGUUCUAGAAUGUCCUGCC | 406 | chr7 | ENST00000252723.2 |
| EPO | CCCUCUGGGCCUCCCAGUCC | 407 | chr7 | ENST00000252723.2 |
| EPO | CCUGGAGAGGUACCUCUUGG | 408 | chr7 | ENST00000252723.2 |
| FAM3B | UUACAGCUCCAGUCCCCAAA | 409 | chr21 | ENST00000357985.6 |
| FAM3B | UGUAGGCAUAGGUGUCAGAU | 410 | chr21 | ENST00000357985.6 |
| FAM3B | GUUAUCCUCAAAGCAGAUUU | 411 | chr21 | ENST00000357985.6 |
| FAM3C | CUGAUAGUGCAUUUUACUUU | 412 | chr7 | ENST00000359943.7 |
| FAM3C | AUUGUUCUUACCAUUUGCCA | 413 | chr7 | ENST00000359943.7 |
| FAM3C | UCCCCCUUCAGUUUAAUGAG | 414 | chr7 | ENST00000359943.7 |
| FAM3D | GUGUCUUAGGUACUUACAUG | 415 | chr3 | ENST00000358781.6 |
| FAM3D | UUUGCGUUUAAAAUCUGCAG | 416 | chr3 | ENST00000358781.6 |
| FAM3D | GAGGUUAAAAAGUACAAGUG | 417 | chr3 | ENST00000358781.6 |
| FAS | CACUUGGGCAUUAACACUUU | 418 | chr10 | ENST00000355740.6 |
| FAS | UACAGUUGAGACUCAGAACU | 419 | chr10 | ENST00000355740.6 |
| FAS | GUGUAACAUACCUGGAGGAC | 420 | chr10 | ENST00000355740.6 |
| FASLG | UGGGGAUAUGGGUAAUUGAA | 421 | chr1 | ENST00000367721.2 |
| FASLG | AACUGUGCCUGGAGGGGCCC | 422 | chr1 | ENST00000367721.2 |
| FASLG | GGUGGUGGCCUCCUUUGACC | 423 | chr1 | ENST00000367721.2 |
| FGF2 | CCGCAGGGACCAUGGCAGCC | 424 | chr4 | ENST00000608478.1 |
| FGF2 | GGGUCCUUGAAGUGGCCGGG | 425 | chr4 | ENST00000608478.1 |
| FGF2 | ACGCCGAGUUGACGGGGUC | 426 | chr4 | ENST00000608478.1 |
| FLT3LG | CUCUAGGAGGAGCUCUGCGG | 427 | chr19 | ENST00000594009.5 |
| FLT3LG | GAGCGGCUCAAGACUGUCGC | 428 | chr19 | ENST00000594009.5 |
| FLT3LG | GCUGACCUGAAAGGCACAUU | 429 | chr19 | ENST00000594009.5 |
| FOXP3 | AGGACCCGAUGCCCAACCCC | 430 | chrX | ENST00000376207.8 |
| FOXP3 | CCGAGGGCUUGCCAGGCCUG | 431 | chrX | ENST00000376207.8 |
| FOXP3 | CCGAUGCCCAACCCCAGGCC | 432 | chrX | ENST00000376207.8 |
| FOXP3 | CCCCAGGCCUGGCAAGCCCU | 433 | chrX | ENST00000376207.8 |
| FZD4 | UCGUCCCCGAAGCCCCGCGC | 434 | chr11 | ENST00000531380.1 |
| FZD4 | CAGACUGAGACCGACGCCCC | 435 | chr11 | ENST00000531380.1 |
| FZD4 | CGAUGCUGGCCAUGGCCUGG | 436 | chr11 | ENST00000531380.1 |
| GATA3 | GAGCACAGCCGAGGCCAUGG | 437 | chr10 | ENST00000346208.4 |
| GATA3 | CUGGUCCGCCGUCACCUCCA | 438 | chr10 | ENST00000346208.4 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| GATA3 | AGCCGAGGCCAUGGAGGUGA | 439 | chr10 | ENST00000346208.4 |
| GATA3 | CGAGGCCAUGGAGGUGACGG | 440 | chr10 | ENST00000346208.4 |
| GBP1 | UCCUCACAUCUUCAUAAUGG | 441 | chr1 | ENST00000370473.4 |
| GBP1 | CAAGCUGGCUGGAAAGAAAA | 442 | chr1 | ENST00000370473.4 |
| GBP1 | UUCUGCCAUUACACAGCCUA | 443 | chr1 | ENST00000370473.4 |
| GDF1 | CGUCCGCCGCGAGCCAGACC | 444 | chr19 | ENST00000247005.7 |
| GDF1 | GGCCGGUUCCCCCGGUCAUG | 445 | chr19 | ENST00000247005.7 |
| GDF1 | GGGGCACGGGGCGCGGGUC | 446 | chr19 | ENST00000247005.7 |
| GDF10 | CCAUGGCUCAUGUCCCCGCU | 447 | chr10 | ENST00000580279.1 |
| GDF10 | CGUUGUUUCUGCUGUUGCUC | 448 | chr10 | ENST00000580279.1 |
| GDF10 | CGCGGGCAGUGCGGACCAGG | 449 | chr10 | ENST00000580279.1 |
| GDF11 | ACGGGGCAGCCGUCCGGCUC | 450 | chr12 | ENST00000257868.9 |
| GDF11 | UCUGCGACUUGAUGCUCUCU | 451 | chr12 | ENST00000257868.9 |
| GDF11 | CACCACCUCGCGGCUGAUGU | 452 | chr12 | ENST00000257868.9 |
| GDF15 | CACCGUCCUGAGUUCUUGCC | 453 | chr19 | ENST00000252809.3 |
| GDF15 | GCUCGCCUCGGCCAGAGACA | 454 | chr19 | ENST00000252809.3 |
| GDF15 | CUCUCGGAAUCUGGAGUCUU | 455 | chr19 | ENST00000252809.3 |
| GDF2 | GCGGGCCUAAGAUGUGUCCU | 456 | chr10 | ENST00000581492.2 |
| GDF2 | CUGCAGUGGCUUCCCCUGUA | 457 | chr10 | ENST00000581492.2 |
| GDF2 | AGGCACCCCCAGUGGGCUGU | 458 | chr10 | ENST00000581492.2 |
| GDF3 | AAAAUUUCUUCAAGAUAUA | 459 | chr12 | ENST00000329913.3 |
| GDF3 | CCUUAUCUAAGCCCAGAAAU | 460 | chr12 | ENST00000329913.3 |
| GDF3 | GUUAAUUCUGGCUUUGGGCC | 461 | chr12 | ENST00000329913.3 |
| GDF5 | CCCUGGCCUGAAGACGUUCC | 462 | chr20 | ENST00000374369.7 |
| GDF5 | UGACUUGGGCCAGAGACCCC | 463 | chr20 | ENST00000374369.7 |
| GDF5 | GGUACCAAAGCAAGAAAGUG | 464 | chr20 | ENST00000374369.7 |
| GDF6 | GCGGCUUCGCAUGCCCUUGG | 465 | chr8 | ENST00000287020.6 |
| GDF6 | GGAUUUGCCCGGUUUCCAGC | 466 | chr8 | ENST00000287020.6 |
| GDF6 | GCCCGCCAUGGAUACUCCCA | 467 | chr8 | ENST00000287020.6 |
| GDF7 | AGCGCCUGCCGCCCCCGCGA | 468 | chr2 | ENST00000272224.4 |
| GDF7 | GCUGGGCCGGUCCGGAGCCC | 469 | chr2 | ENST00000272224.4 |
| GDF7 | UGCGGGCGCCGCGGCUGUCC | 470 | chr2 | ENST00000272224.4 |
| GDF9 | AUACCUGUUACCUGGUCUCC | 471 | chr5 | ENST00000378673.2 |
| GDF9 | AGAGCCGAACAGUGUUGUAG | 472 | chr5 | ENST00000378673.2 |
| GDF9 | CUAUAAGACAUAUGCUACCA | 473 | chr5 | ENST00000378673.2 |
| GPI | GUCCCGGGUGAGAGCGGCCA | 474 | chr19 | ENST00000356487.9 |

TABLE 10-continued

Additional guide RNA sequences for use in
reducing the incidence of CRS

| Target Gene Symbol | Guide RNA Sequence | SEQ ID NO: | Location | Gene ID No. |
|---|---|---|---|---|
| GPI | UCAGCUCGGAGCGGUGCUCG | 475 | chr19 | ENST00000356487.9 |
| GPI | CGGCCCGCCCGCACCUGAAG | 476 | chr19 | ENST00000356487.9 |
| GREM1 | UAUGAGCCGCACAGCCUACA | 477 | chr15 | ENST00000622074.1 |
| GREM1 | CCCUUCAGCAGCCGGCAGCA | 478 | chr15 | ENST00000622074.1 |
| GREM1 | UUGUGCUGGGCCUUGUCUGG | 479 | chr15 | ENST00000622074.1 |
| GREM2 | CGGUGACCACCAGGGCCUCC | 480 | chr1 | ENST00000318160.4 |
| GREM2 | GCAGCAACAACUCGGAGAGA | 481 | chr1 | ENST00000318160.4 |
| GREM2 | GCUUUCCCUGUCCUUGUUCC | 482 | chr1 | ENST00000318160.4 |
| GRN | CAGGCAGACCAUGUGGACCC | 483 | chr17 | ENST00000053867.7 |
| GRN | GCUGGAACGCGGUGCCCAGA | 484 | chr17 | ENST00000053867.7 |
| GRN | AGCUGGCUCCUCCGGGGUCC | 485 | chr17 | ENST00000053867.7 |
| HAX1 | CACCUUUCUGCAGAACUUCC | 486 | chr1 | ENST00000328703.11 |
| HAX1 | UACGGGAGGGACAGACACUU | 487 | chr1 | ENST00000328703.11 |
| HAX1 | CCAGUCUGGUGCUGGUUGGG | 488 | chr1 | ENST00000328703.11 |
| HFE2 | AGGAGCGGAGGGCUCGACAG | 489 | chr1 | ENST00000336751.10 |
| HFE2 | UCAUCAGGAGCACUUCGAGG | 490 | chr1 | ENST00000336751.10 |
| HFE2 | CGUACUCAGCAUUGCAGCGG | 491 | chr1 | ENST00000336751.10 |
| HMGB1* | GAUACUCACGGAGGCCUCUU | 492 | chr13 | ENST00000339872.8 |
| HMGB1* | GAUACUCACGGAGGCCUCUU | 493 | chr13 | ENST00000339872.8 |
| HMGB1* | GAUACUCACGGAGGCCUCUU | 494 | chr13 | ENST00000339872.8 |
| HYAL2 | GCGUGGGCCACAGUCCUGUG | 495 | chr3 | ENST00000357750.8 |
| HYAL2 | UGCUGUGGGCUUGAGCUCCA | 496 | chr3 | ENST00000357750.8 |
| HYAL2 | GCAGCCCCAGCAUGCGGGC | 497 | chr3 | ENST00000357750.8 |
| ICAM3** | UCAUGUUCCUGAAGGUGUCC | 498 | chr19 | ENST00000160262.9 |
| ICAM3** | CAUGUUCCUGAAGGUGUCCA | 499 | chr19 | ENST00000160262.9 |
| ICAM3** | AUGUUCCUGAAGGUGUCCAG | 500 | chr19 | ENST00000160262.9 |
| ICAM3** | UCCUGAAGGUGUCCAGGGGC | 501 | chr19 | ENST00000160262.9 |
| ICOS** | UUUUAUGCAGGAGAAAUCAA | 502 | ch2 | ENST00000316386.10 |
| ICOS** | GAGAUGUUUAUAUUUCACAA | 503 | ch2 | ENST00000316386.10 |
| ICOS** | AUGUUUAUAUUUCACAACGG | 504 | ch2 | ENST00000316386.10 |
| ICOS** | UUUAAAAUGCAGUUGCUGAA | 505 | ch2 | ENST00000316386.10 |
| IFNA10 | CAAACUCCUCCUGGGGGAUU | 506 | chr9 | ENST00000357374.2 |
| IFNA10 | CAAACUCCUCCUGGGGGAUU | 507 | chr9 | ENST00000357374.2 |
| IFNA10 | CAAACUCCUCCUGGGGGAUU | 508 | chr9 | ENST00000357374.2 |
| IFNA14 | CAGGAGGACUUUGAUGCUCA | 509 | chr9 | ENST00000380222.3 |
| IFNA14 | AAGCAAAGGGCAAUGCCAUU | 510 | chr9 | ENST00000380222.3 |
| IFNA14 | AAGCAAAGGGCAAUGCCAUU | 511 | chr9 | ENST00000380222.3 |

TABLE 10-continued

Additional guide RNA sequences for use in
reducing the incidence of CRS

| Target Gene Symbol | Guide RNA Sequence | SEQ ID NO: | Location | Gene ID No. |
|---|---|---|---|---|
| IFNA16 | CAUCUCAUGGAAGGCAGAGA | 512 | chr9 | ENST00000380216.1 |
| IFNA16 | AUAUGAUUUCGGAUUCCCCC | 513 | chr9 | ENST00000380216.1 |
| IFNA16 | AUAUGAUUUCGGAUUCCCCC | 514 | chr9 | ENST00000380216.1 |
| IFNA2 | UCAAGGUCCUCCUGCUACCC | 515 | chr9 | ENST00000380206.3 |
| IFNA2 | CACCAGUAAAGCAAAGGUCA | 516 | chr9 | ENST00000380206.3 |
| IFNA2 | CACCAGUAAAGCAAAGGUCA | 517 | chr9 | ENST00000380206.3 |
| IFNA5 | UUGAUGAUAAUGGCACAAAU | 518 | chr9 | ENST00000610521.1 |
| IFNA5 | CUUGCCCUUUGUUUUACUGA | 519 | chr9 | ENST00000610521.1 |
| IFNA5 | CUUGCCCUUUGUUUUACUGA | 520 | chr9 | ENST00000610521.1 |
| IFNA6 | AGGUCUGCUGAAUCACCUCA | 521 | chr9 | ENST00000380210.1 |
| IFNA6 | ACAUGACUUCAGAUUUCCCC | 522 | chr9 | ENST00000380210.1 |
| IFNA6 | UCAUGGUCCUCCUGUGACCC | 523 | chr9 | ENST00000380210.1 |
| IFNA8 | UACAAGUCAUUCAGCUCUCU | 524 | chr9 | ENST00000380205.1 |
| IFNA8 | GUUUAUCAUCAAACUCCUCC | 525 | chr9 | ENST00000380205.1 |
| IFNA8 | GUUUAUCAUCAAACUCCUCC | 526 | chr9 | ENST00000380205.1 |
| IFNAR1 | UUUACUUUAAAGAACUGGGA | 527 | chr21 | ENST00000270139.7 |
| IFNAR1 | GAGUGAAGAAAAGUUGCAUU | 528 | chr21 | ENST00000270139.7 |
| IFNAR1 | AAACACUUCUUCAUGGUAUG | 529 | chr21 | ENST00000270139.7 |
| IFNAR2 | UAAACCAGAAGAUUUGAAGG | 530 | chr21 | ENST00000342136.8 |
| IFNAR2 | UGAGUGGAGAAGCACACACG | 531 | chr21 | ENST00000342136.8 |
| IFNAR2 | UCAGUUGCUCACACAAUUUC | 532 | chr21 | ENST00000342136.8 |
| IFNB1 | UUGAAUACUGCCUCAAGGAC | 533 | chr9 | ENST00000380232.3 |
| IFNB1 | GAAAAUUGCUGCUUCUUUGU | 534 | chr9 | ENST00000380232.3 |
| IFNB1 | AGCACAACAGGAGAGCAAUU | 535 | chr9 | ENST00000380232.3 |
| IFNE | UGGCCAGAGUGUGUCCUUUU | 536 | chr9 | ENST00000448696.4 |
| IFNE | UAGACACUGCUGAAUUGACA | 537 | chr9 | ENST00000448696.4 |
| IFNE | CUUGAUUCACUUGUCUUUGC | 538 | chr9 | ENST00000448696.4 |
| IFNG* | UUUUUAAUAGUACUUGUUUG | 539 | chr12 | ENST00000229135.3 |
| IFNG* | CUUCUUUUACAUAUGGGUCC | 540 | chr12 | ENST00000229135.3 |
| IFNG* | GAAAUAUACAAGUUAUAUCU | 541 | chr12 | ENST00000229135.3 |
| IFNGR1** | AUUGUACACCCUAAUGUAAC | 542 | chr6 | ENST00000367739.8 |
| IFNGR1** | CUCCAUUUACAAAAACUGAA | 543 | chr6 | ENST00000367739.8 |
| IFNGR1** | UUUCUGAUAUCCAGUUUAGG | 544 | chr6 | ENST00000367739.8 |
| IFNK | UUGUGGCUUGAGAUCCUUAU | 545 | chr9 | ENST00000276943.2 |
| IFNK | CGUUCAGUAAGUUACAGUCC | 546 | chr9 | ENST00000276943.2 |
| IFNK | UUUUCUCGUAGACAUUCUAC | 547 | chr9 | ENST00000276943.2 |

TABLE 10-continued

Additional guide RNA sequences for use in reducing the incidence of CRS

| Target Gene Symbol | Guide RNA Sequence | SEQ ID NO: | Location | Gene ID No. |
| --- | --- | --- | --- | --- |
| IFNL1 | AUUUAGCCAUGGCUGCAGCU | 548 | chr19 | ENST00000333625.2 |
| IFNL1 | GUGGCAGCCCUUCCCAGUUG | 549 | chr19 | ENST00000333625.2 |
| IFNL1 | UAGCGAGCUUCAAGAAGGCC | 550 | chr19 | ENST00000333625.2 |
| IFNL3 | CGGGCCUGUGUGAGUCGUCA | 551 | chr19 | ENST00000413851.2 |
| IFNL3 | CCAAGACAUCCCCCAGGGCU | 552 | chr19 | ENST00000413851.2 |
| IFNL3 | CCAAGACAUCCCCCAGGGCU | 553 | chr19 | ENST00000413851.2 |
| IFNW1 | CUCCCUUUUACCAUCUCCUG | 554 | chr9 | ENST00000380229.3 |
| IFNW1 | CAUUUGGUGCAGAAGCACCA | 555 | chr9 | ENST00000380229.3 |
| IFNW1 | AGAUCCAACAGGGCUAUAGC | 556 | chr9 | ENST00000380229.3 |
| IL10* | CGGAGAUCUCGAAGCAUGUU | 557 | chr1 | ENST00000423557.1 |
| IL10* | UCAGACUGGGUGCCCUGGCC | 558 | chr1 | ENST00000423557.1 |
| IL10* | CUCAGCACUGCUCUGUUGCC | 559 | chr1 | ENST00000423557.1 |
| IL10RA** | GGUCUGGCUACAGUUGGAGA | 560 | chr11 | ENST00000227752.7 |
| IL10RA** | GGUAGCCAUUGCUGUGGUAC | 561 | chr11 | ENST00000227752.7 |
| IL10RA** | GGUGUUGGUGACGGUCCAGU | 562 | chr11 | ENST00000227752.7 |
| IL11 | CGUGCCGCAGGUAGGACAGU | 563 | chr19 | ENST00000264563.6 |
| IL11 | CGGCUCUAUCCCCAGCUCCC | 564 | chr19 | ENST00000264563.6 |
| IL11 | CACUGGGAGCUCUACAGGUA | 565 | chr19 | ENST00000264563.6 |
| IL11RA | AGUGUCCUGGUUUCGGGAUG | 566 | chr9 | ENST00000318041.13 |
| IL11RA | GCUAGGGCAUGAACUGGUCC | 567 | chr9 | ENST00000318041.13 |
| IL11RA | UGCCCCAAGUGCACCAUCC | 568 | chr9 | ENST00000318041.13 |
| IL12A | CCAGGGUAGCCACAAGGAGG | 569 | chr3 | ENST00000305579.6 |
| IL12A | GGUCUGGAGUGGCCACGGGG | 570 | chr3 | ENST00000305579.6 |
| IL12A | UGACGGCCCUCAGCAGGUUU | 571 | chr3 | ENST00000305579.6 |
| IL12B | ACUCUUUGACUUGGAUGGUC | 572 | chr5 | ENST00000231228.2 |
| IL12B | GGUGAUACCAUCUUCUUCAG | 573 | chr5 | ENST00000231228.2 |
| IL12B | UUUAUGUCGUAGAAUUGGAU | 574 | chr5 | ENST00000231228.2 |
| IL12RB1^ | CACUUCCUGCGGUGUUGGUG | 575 | chr19 | ENST00000593993.6 |
| IL12RB1^ | GGAGCACUCGUAACGAUCAC | 576 | chr19 | ENST00000593993.6 |
| IL12RB1^ | AUCUCUUCCAGGCUCGGCCU | 577 | chr19 | ENST00000593993.6 |
| IL13* | CAUGGCGCUUUUGUUGACCA | 578 | chr5 | ENST00000304506.7 |
| IL13* | GCCUCCCUCUACAGCCCUCA | 579 | chr5 | ENST00000304506.7 |
| IL13* | CGACACUCACCUUCUGGUUC | 580 | chr5 | ENST00000304506.7 |
| IL15 | AUGGAAAUACUUCUCAAAUG | 581 | chr4 | ENST00000296545.11 |
| IL15 | GGCAUUCAUGUCUUCAUUUU | 582 | chr4 | ENST00000296545.11 |
| IL15 | AUGGUCAUGAUGAUUGUCCU | 583 | chr4 | ENST00000296545.11 |
| IL16 | CAAAAUUUCGGUCCAUCUCC | 584 | chr15 | ENST00000302987.8 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| IL16 | AGGGCUAGAGCCAUCAUCAC | 585 | chr15 | ENST00000302987.8 |
| IL16 | GGAAAAUUCCCUCCUUGCCC | 586 | chr15 | ENST00000302987.8 |
| IL17A^ | GCUACUGCUGCUGAGCCUGG | 587 | chr6 | ENST00000340057.1 |
| IL17A^ | UCAACCUGAACAUCCAUAAC | 588 | chr6 | ENST00000340057.1 |
| IL17A^ | GGAUCGGUUGUAGUAAUCUG | 589 | chr6 | ENST00000340057.1 |
| IL17B^ | GCUCUGAGCUGUUCCUCAGC | 590 | chr5 | ENST00000261796.3 |
| IL17B^ | GAAACCGUAUGCCCGCAUGG | 591 | chr5 | ENST00000261796.3 |
| IL17B^ | CUCUUGCUUUUGGGGCUCCU | 592 | chr5 | ENST00000261796.3 |
| IL17C^ | UCAGAAACAGGAGGCCGGGG | 593 | chr16 | ENST00000244241.4 |
| IL17C^ | CGGUACCCCACACUGCUACU | 594 | chr16 | ENST00000244241.4 |
| IL17C^ | GCACCUCGAGCCAGCAGGUG | 595 | chr16 | ENST00000244241.4 |
| IL17D^ | CGGCAGCGCCAGCAGGAAGC | 596 | chr13 | ENST00000304920.3 |
| IL17D^ | GGACCGGCCGGAGGAGCUAC | 597 | chr13 | ENST00000304920.3 |
| IL17D^ | GUGGAAGGCACUGAGCACGC | 598 | chr13 | ENST00000304920.3 |
| IL17F^ | GGUAGUAUGAAGCUUGACAU | 599 | chr6 | ENST00000336123.4 |
| IL17F^ | GAAAAAGUAUGUCCUACUU | 600 | chr6 | ENST00000336123.4 |
| IL17F^ | UACUUGCUGCUGUCGAUAUU | 601 | chr6 | ENST00000336123.4 |
| IL18 | GGAAAUAAUUUUGUUCUCAC | 602 | chr11 | ENST00000280357.11 |
| IL18 | UUACAGCCAUACCUCUAGGC | 603 | chr11 | ENST00000280357.11 |
| IL18 | UUAUUUCAGAUAAUGCACCC | 604 | chr11 | ENST00000280357.11 |
| IL18BP | GCAGGACCCACAAAGGGCUG | 605 | chr11 | ENST00000260049.9 |
| IL18BP | UGUGCUUCUAACUGAGGCAG | 606 | chr11 | ENST00000260049.9 |
| IL18BP | GCUGGACACUGCUUAGCUGC | 607 | chr11 | ENST00000260049.9 |
| IL19 | AGUUACAGUGUGUUUCCCUU | 608 | chr1 | ENST00000270218.10 |
| IL19 | CAGUAGACAACCACGGUCUC | 609 | chr1 | ENST00000270218.10 |
| IL19 | CUUGGAAACUCUCUUCUAUA | 610 | chr1 | ENST00000270218.10 |
| IL1A | GGAAGGUUCUGAAGAAGAGA | 611 | chr2 | ENST00000263339.3 |
| IL1A | GGUAAGCUUGGAUGUUUUAG | 612 | chr2 | ENST00000263339.3 |
| IL1A | GCCAUAGCUUACAUGAUAGA | 613 | chr2 | ENST00000263339.3 |
| IL1B* | CAUUCUCCUGGAAGGUCUGU | 614 | chr2 | ENST00000263341.6 |
| IL1B* | CAUGGCCACAACAACUGACG | 615 | chr2 | ENST00000263341.6 |
| IL1B* | CUCUCCGCAGUGCUCCUUCC | 616 | chr2 | ENST00000263341.6 |
| IL1F10 | AUCUGCAUACUUCCUAACAG | 617 | chr2 | ENST00000341010.6 |
| IL1F10 | CCAGGCAGCGGCUCCCUCCC | 618 | chr2 | ENST00000341010.6 |
| IL1F10 | GGCCUCUCACCUCCAGCUGU | 619 | chr2 | ENST00000341010.6 |
| IL1R1** | UCCUUUUAAAGAUAAAUGCA | 620 | chr2 | ENST00000410023.5 |

TABLE 10-continued

Additional guide RNA sequences for use in
reducing the incidence of CRS

| Target Gene Symbol | Guide RNA Sequence | SEQ ID NO: | Location | Gene ID No. |
|---|---|---|---|---|
| IL1R1** | CUUAACCCAAAUGAACACAA | 621 | chr2 | ENST00000410023.5 |
| IL1R1** | UAUCUACAGAACAAGCCUCC | 622 | chr2 | ENST00000410023.5 |
| IL1R2** | CCAGAAGCUGCCGGUUUCGU | 623 | chr2 | ENST00000332549.7 |
| IL1R2** | UGUAGCCCUGAGGUGCCCCC | 624 | chr2 | ENST00000332549.7 |
| IL1R2** | UAAAAAUGACUCUGCUAGGA | 625 | chr2 | ENST00000332549.7 |
| IL1RAPL1** | AAUUCUUAAGGAGCAUCUUG | 626 | chrX | ENST00000378993.5 |
| IL1RAPL1** | CUCUGUGGAAGAAGGUGACU | 627 | chrX | ENST00000378993.5 |
| IL1RAPL1** | UACACUCACCUCGUUUAUGA | 628 | chrX | ENST00000378993.5 |
| IL1RL1** | UUUCUUAUUUCAGAAUUGUC | 629 | chr2 | ENST00000233954.5 |
| IL1RL1** | AAUGUGAUGACUGAGGACGC | 630 | chr2 | ENST00000233954.5 |
| IL1RL1** | ACCCUUGACCGUGAAGGACC | 631 | chr2 | ENST00000233954.5 |
| IL1RN** | UUCCCCAGAAAAGAUAGAUG | 632 | chr2 | ENST00000409930.3 |
| IL1RN** | ACAGGCACAUCUUCCCUCCA | 633 | chr2 | ENST00000409930.3 |
| IL1RN** | AGCAUGUUUUUACCUCCAGC | 634 | chr2 | ENST00000409930.3 |
| IL2 | UGUAAUAAUUUUAGUAAGAA | 635 | chr4 | ENST00000226730.4 |
| IL2 | ACAACUGGAGCAUUUACUGC | 636 | chr4 | ENST00000226730.4 |
| IL2 | GACUUAGUGCAAUGCAAGAC | 637 | chr4 | ENST00000226730.4 |
| IL20 | AAGGCUGAAGGCAAGACUAG | 638 | chr1 | ENST00000367096.7 |
| IL20 | UGGACUGAAGACACUCAAUU | 639 | chr1 | ENST00000367096.7 |
| IL20 | UUCUGAGAUACGGGGCAGUG | 640 | chr1 | ENST00000367096.7 |
| IL20RA | CAUCCCCGACCCGCACCUGG | 641 | chr6 | ENST00000316649.9 |
| IL20RA | UGUUGCUCCUGGCGGCGCCU | 642 | chr6 | ENST00000316649.9 |
| IL20RA | CCGCCGCCCAUGCGGGCUCC | 643 | chr6 | ENST00000316649.9 |
| IL20RB | AGUGAGUGAGCACCAGCUGC | 644 | chr3 | ENST00000329582.8 |
| IL20RB | UGCCAUACAACCUUCGUGUC | 645 | chr3 | ENST00000329582.8 |
| IL20RB | UUCUAUUAAAGGGAUGCUUC | 646 | chr3 | ENST00000329582.8 |
| IL21 | GAAAAAUUAUGUGAAUGACU | 647 | chr4 | ENST00000264497.7 |
| IL21 | UCAUGUGGCGAUCUUGACCU | 648 | chr4 | ENST00000264497.7 |
| IL21 | ACAAUCCUCUCCAUGUUGCC | 649 | chr4 | ENST00000264497.7 |
| IL22^ | UGGACUUGUCAAGCCUGCAG | 650 | chr12 | ENST00000328087.5 |
| IL22^ | UCUCUUGGCCCUCUUGGUAC | 651 | chr12 | ENST00000328087.5 |
| IL22^ | AAGAGCUCACAGAUUUCUGC | 652 | chr12 | ENST00000328087.5 |
| IL22RA1^ | GAUGUCUGGCUGCCCUAAGU | 653 | chr1 | ENST00000270800.1 |
| IL22RA1^ | UCUGGACCCAGGGAGCCCGC | 654 | chr1 | ENST00000270800.1 |
| IL22RA1^ | CAGGGAUCAGGACGUGCUCC | 655 | chr1 | ENST00000270800.1 |
| IL22RA2^ | UUCUGAGUAGCUCCCAGCCG | 656 | chr6 | ENST00000349184.8 |
| IL22RA2^ | CUGUAUGUCUGAGGUUUCAC | 657 | chr6 | ENST00000349184.8 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| IL22RA2^ | ACAGAUAUGGACAGAGACAA | 658 | chr6 | ENST00000349184.8 |
| IL23A* | CUGCUGCCCUGGACAGCUCA | 659 | chr12 | ENST00000228534.5 |
| IL23A* | AAGCUGCUGGCACUGAGUCC | 660 | chr12 | ENST00000228534.5 |
| IL23A* | CUCACCAUGUGUCCCACUAG | 661 | chr12 | ENST00000228534.5 |
| IL23R** | CUGUUGCACAUAUGUAAAAU | 662 | chr1 | ENST00000347310.9 |
| IL23R** | GAUGUCAAGAAACAGGCAAA | 663 | chr1 | ENST00000347310.9 |
| IL23R** | UAAGUACACUCACCUGUUUC | 664 | chr1 | ENST00000347310.9 |
| IL24 | UGAGAGGCUGUCGCCAGCAA | 665 | chr1 | ENST00000294984.6 |
| IL24 | CUUCUCUGGAGCCAGGUAUC | 666 | chr1 | ENST00000294984.6 |
| IL24 | ACAACCCCCUUCACUUGGCA | 667 | chr1 | ENST00000294984.6 |
| IL25 | CCUACAGGUGGUUGCAUUCU | 668 | chr14 | ENST00000329715.2 |
| IL25 | GAGGUGUCCUGCCCUUUGCU | 669 | chr14 | ENST00000329715.2 |
| IL25 | UGCCUCCCCUAGAGCCUGCU | 670 | chr14 | ENST00000329715.2 |
| IL26 | AUAGAGAGCGUCAACAGCUU | 671 | chr12 | ENST00000229134.4 |
| IL26 | AGAUUGCUUGUGCUUGGCAA | 672 | chr12 | ENST00000229134.4 |
| IL26 | UGCUGGUGAAUUUCAUUUUG | 673 | chr12 | ENST00000229134.4 |
| IL27 | CAUUAGGGGGACUUACAAAG | 674 | chr16 | ENST00000356897.1 |
| IL27 | GCAGCUCCUGCAGGCUCAGC | 675 | chr16 | ENST00000356897.1 |
| IL27 | ACCAGCUUGAACCAGGAGCA | 676 | chr16 | ENST00000356897.1 |
| IL2RA | CAGAGCUUGUGCAUUGACAU | 677 | chr10 | ENST00000379959.7 |
| IL2RA | GUGACCCGCUUUUUAUUCUG | 678 | chr10 | ENST00000379959.7 |
| IL2RA | AUGGCUUUGAAUGUGGCGUG | 679 | chr10 | ENST00000379959.7 |
| IL2RB | UGUGGCCUGGGGACAGCGUC | 680 | chr22 | ENST00000216223.9 |
| IL2RB | CCCACAGAUGCAACAUAAGC | 681 | chr22 | ENST00000216223.9 |
| IL2RB | GUUGUCUCCAGUUCGCCUGA | 682 | chr22 | ENST00000216223.9 |
| IL2RG | CAUACCAAUAAUGCAGAGUG | 683 | chrX | ENST00000374202.6 |
| IL2RG | UCGAGUACAUGAAUUGCACU | 684 | chrX | ENST00000374202.6 |
| IL2RG | GAAACACUGAGGGAGUCAGU | 685 | chrX | ENST00000374202.6 |
| IL3* | GCAGGAGCAGGACGGGCAGG | 686 | chr5 | ENST00000296870.2 |
| IL3* | CAACGCCCUUGAAGACAAGC | 687 | chr5 | ENST00000296870.2 |
| IL3* | CUACUCACCAGCAAAGGCAA | 688 | chr5 | ENST00000296870.2 |
| IL31 | CUUUCAAAAGCAUCUUCGAG | 689 | chr12 | ENST00000377035.1 |
| IL31 | GUAACGGACGGGCAACGUG | 690 | chr12 | ENST00000377035.1 |
| IL31 | AGAAAGAGCACAGACGUCGA | 691 | chr12 | ENST00000377035.1 |
| IL31RA | CAACUUCGCUAAGAACCGUA | 692 | chr5 | ENST00000447346.6 |
| IL31RA | AGCUCUGCGAUGUGCGGUCA | 693 | chr5 | ENST00000447346.6 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| IL31RA | CAGUCAUUCCCAUUUUUUCU | 694 | chr5 | ENST00000447346.6 |
| IL32 | CUGCCUCUCUUCACAGCACC | 695 | chr16 | ENST00000325568.9 |
| IL32 | AGAAUCAGGACGUGGACAGG | 696 | chr16 | ENST00000325568.9 |
| IL32 | UCAGGGUGAGAAGGAUGAAG | 697 | chr16 | ENST00000325568.9 |
| IL33 | UUGUUUAGAAUCCCAACAGA | 698 | chr9 | ENST00000381434.7 |
| IL33 | CUCUGGCCUUAUGAUAAAAA | 699 | chr9 | ENST00000381434.7 |
| IL33 | UUUCAGUGAAGGCCUUUUGG | 700 | chr9 | ENST00000381434.7 |
| IL34 | UCUUGGGAUCUUCCUUGGCG | 701 | chr16 | ENST00000288098.6 |
| IL34 | GCACUCCUCAUUCUGCGUCA | 702 | chr16 | ENST00000288098.6 |
| IL34 | CAGGAGCCGACUUCAGUACA | 703 | chr16 | ENST00000288098.6 |
| IL36A | CACAUGUCGGCAUGAGAUUA | 704 | chr2 | ENST00000259211.6 |
| IL36A | GAUUGAGUCCAUUCAGGCCC | 705 | chr2 | ENST00000259211.6 |
| IL36A | ACUCACCUUCAGCUGCAGUG | 706 | chr2 | ENST00000259211.6 |
| IL36B | CAAGCCUACUUUGCAGCUUA | 707 | chr2 | ENST00000327407.2 |
| IL36B | UAUGGUUUACCUGGGAAUCA | 708 | chr2 | ENST00000327407.2 |
| IL36B | GCUAUUAAAUGAAGAGUGAC | 709 | chr2 | ENST00000327407.2 |
| IL36G | UCAGUGUGUAAACCUAUUAC | 710 | chr2 | ENST00000259205.4 |
| IL36G | CACAAGGUUCUGACCCUGAA | 711 | chr2 | ENST00000259205.4 |
| IL36G | CUGUUUGCACUGCUGUGGCU | 712 | chr2 | ENST00000259205.4 |
| IL36RN | CACAGGUGAAGAGAUCAGCG | 713 | chr2 | ENST00000346807.7 |
| IL36RN | CACCCAGGAUGACGGGGGAC | 714 | chr2 | ENST00000346807.7 |
| IL36RN | GGAGCCGACUCUAACACUAG | 715 | chr2 | ENST00000346807.7 |
| IL37 | GCUAAUGCAAAGAAGAUCUC | 716 | chr2 | ENST00000263326.7 |
| IL37 | AUUCUCCUGGGGGUCUCUAA | 717 | chr2 | ENST00000263326.7 |
| IL37 | AACUCUCACCUUCAGCUGAA | 718 | chr2 | ENST00000263326.7 |
| IL4* | CAGAGGGGGAAGCAGUUGGG | 719 | chr5 | ENST00000231449.6 |
| IL4* | UGAUAUCGCACUUGUGUCCG | 720 | chr5 | ENST00000231449.6 |
| IL4* | UACUCACCUUCUGCUCUGUG | 721 | chr5 | ENST00000231449.6 |
| IL5* | CAUAAAGAAAAUUACCUCAU | 722 | chr5 | ENST00000231454.5 |
| IL5* | UGCAUUGGUGAAAGAGACCU | 723 | chr5 | ENST00000231454.5 |
| IL5* | CAUUUGAGUUUGCUAGCUCU | 724 | chr5 | ENST00000231454.5 |
| IL6* | CCCUCCGGCACAGGCGCCUU | 725 | chr7 | ENST00000258743.9 |
| IL6* | ACAUCUUUGGAAUCUUCUCC | 726 | chr7 | ENST00000258743.9 |
| IL6* | AACGAAUUGACAAACAAAUU | 727 | chr7 | ENST00000258743.9 |
| IL6R** | CAGUCCGGCCGAAGACUUCC | 728 | chr1 | ENST00000368485.7 |
| IL6R** | UAACUGGCAGGAGAACUUCU | 729 | chr1 | ENST00000368485.7 |
| IL6R** | CAGCAAAACUCAAACCUUUC | 730 | chr1 | ENST00000368485.7 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| IL6ST | AUUUACCUGGCUCCAAGUUG | 731 | chr5 | ENST00000336909.9 |
| IL6ST | UUAUAACACUCUUAAUACUU | 732 | chr5 | ENST00000336909.9 |
| IL6ST | UGAUAAAUUAUGUGGCGGAU | 733 | chr5 | ENST00000336909.9 |
| IL7 | GGUCAGCAUCGAUCAAUUAU | 734 | chr8 | ENST00000263851.8 |
| IL7 | AUGCUACUGGCAACAGAACA | 735 | chr8 | ENST00000263851.8 |
| IL7 | UGUCAAAUUUAGUUUCUUUU | 736 | chr8 | ENST00000263851.8 |
| IL9^ | CUACCUGCAUCUUGUUGAUG | 737 | chr5 | ENST00000274520.1 |
| IL9^ | UGGACACCCCUGGCCUGCCA | 738 | chr5 | ENST00000274520.1 |
| IL9^ | UGUCAAGAUGCUUCUGGCCA | 739 | chr5 | ENST00000274520.1 |
| INHA | UCAGCAGCAAGAAGAGCAGU | 740 | chr2 | ENST00000243786.2 |
| INHA | CCGGGAACUUGUUCUGGCCA | 741 | chr2 | ENST00000243786.2 |
| INHA | CCGCGGUGACCAGGGAAGGU | 742 | chr2 | ENST00000243786.2 |
| INHBA | UGAACUUAUGGAGCAGACCU | 743 | chr7 | ENST00000242208.4 |
| INHBA | GAACGGGUAUGUGGAGAUAG | 744 | chr7 | ENST00000242208.4 |
| INHBA | GGGUACCGGCUGGGUGACAU | 745 | chr7 | ENST00000242208.4 |
| INHBB | GGCGGCGGCGCGGCAGGCGU | 746 | chr2 | ENST00000295228.3 |
| INHBB | GUACGUCGUGCGGCGGCUUC | 747 | chr2 | ENST00000295228.3 |
| INHBB | UGUGCCGCUUCACCGCCUCC | 748 | chr2 | ENST00000295228.3 |
| INHBC | AAAGGCCAGAAGCAAUGAGG | 749 | chr12 | ENST00000309668.2 |
| INHBC | UGGACACUGACCGCCAGCUC | 750 | chr12 | ENST00000309668.2 |
| INHBC | GCGGGAGCUGCUUCUUGAUC | 751 | chr12 | ENST00000309668.2 |
| INHBE | AAAGUGAGCAGGGAGCUGU | 752 | chr12 | ENST00000266646.2 |
| INHBE | CAAGCAAAGAGUGCCAGGAA | 753 | chr12 | ENST00000266646.2 |
| INHBE | CCAGGAGAGUGCGGGACCCU | 754 | chr12 | ENST00000266646.2 |
| ITGA4** | CCACCGAGAGCGCAUGGCUU | 755 | chr2 | ENST00000397033.6 |
| ITGA4** | GACCGGCCGCCCCUACAACG | 756 | chr2 | ENST00000397033.6 |
| ITGA4** | AGCCGAACAGCGUGUUGUGG | 757 | chr2 | ENST00000397033.6 |
| ITGAV** | CGGCGAUGGCUUUUCCGCCG | 758 | chr2 | ENST00000261023.7 |
| ITGAV** | GUCCCGAGAGAAGAAGCGGG | 759 | chr2 | ENST00000261023.7 |
| ITGAV** | GACAGUCCUGCCGAGUACUC | 760 | chr2 | ENST00000261023.7 |
| ITGB1** | UGCUGUUCCUUUGCUACGGU | 761 | chr10 | ENST00000302278.7 |
| ITGB1** | GAUGACAUAGAAAAUCCCAG | 762 | chr10 | ENST00000302278.7 |
| ITGB1** | AUUUAGACAUUUUUACAGGA | 763 | chr10 | ENST00000302278.7 |
| ITGB3** | GCGAGGUGAGCCCAGAGGCA | 764 | chr17 | ENST00000559488.5 |
| ITGB3** | AGGCCCGAGUACUAGAGGAC | 765 | chr17 | ENST00000559488.5 |
| ITGB3** | GGGGACUGACUUGAGUGACC | 766 | chr17 | ENST00000559488.5 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| KIT** | CUCAACCAUCUGUGAGUCCA | 767 | chr4 | ENST00000288135.5 |
| KIT** | AUCAGACUUAAUAGUCCGCG | 768 | chr4 | ENST00000288135.5 |
| KIT** | AAAGUCCAUUUGACAAAGCC | 769 | chr4 | ENST00000288135.5 |
| KITLG | UUUCUUUCACGCACUCCACA | 770 | chr12 | ENST00000228280.9 |
| KITLG | AAGUUUUCAAAUAUUUCUGA | 771 | chr12 | ENST00000228280.9 |
| KITLG | UCUUGCAGCCAAGUCAUUGU | 772 | chr12 | ENST00000228280.9 |
| KLHL20 | GCACCGGGAGCUAUGUGAUG | 773 | chr1 | ENST00000209884.4 |
| KLHL20 | UACUUCCGAGCUAUGUUUAC | 774 | chr1 | ENST00000209884.4 |
| KLHL20 | UAGCCCUCUCGUCAAUGUCU | 775 | chr1 | ENST00000209884.4 |
| LEFTY1 | GCUGCAGCAGGGCCACGUAC | 776 | chr1 | ENST00000272134.5 |
| LEFTY1 | CCUCCAUGUCGGCCCUGUCC | 777 | chr1 | ENST00000272134.5 |
| LEFTY1 | GUGUUGCCCCUGGCCAGCCC | 778 | chr1 | ENST00000272134.5 |
| LEFTY2 | AUGUCGGCCCUGUCCAGUAC | 779 | chr1 | ENST00000366820.9 |
| LEFTY2 | CUCCUCGGUCAGGGCCGCCC | 780 | chr1 | ENST00000366820.9 |
| LEFTY2 | GCAGCACCAUGUGGCCCCUG | 781 | chr1 | ENST00000366820.9 |
| LIF | GUCCCGGGUGAUGUUGCCCA | 782 | chr22 | ENST00000249075.3 |
| LIF | UGCCGUUGGCGUGGAAGGGC | 783 | chr22 | ENST00000249075.3 |
| LIF | UGUUGGGGAACGGCUCCCCC | 784 | chr22 | ENST00000249075.3 |
| LIFR | UGAUGCACUUACCCUUUUUC | 785 | chr5 | ENST00000263409.8 |
| LIFR | UAAAUGUUGAUAACAGCCAC | 786 | chr5 | ENST00000263409.8 |
| LIFR | GAAACGACCAUCCUGGAUGG | 787 | chr5 | ENST00000263409.8 |
| LTA | CCCUAGGGGCUCCCUGGUGU | 788 | chr6 | ENST00000418386.2 |
| LTA | GAUGCAUCUUGGGGUGCUGA | 789 | chr6 | ENST00000418386.2 |
| LTA | CAGGUGGAUGUUUACCAAUG | 790 | chr6 | ENST00000418386.2 |
| LTB | UAUCACUGUCCUGGCUGUGC | 791 | chr6 | ENST00000429299.2 |
| LTB | UCCCUCCUGCUAGCUGUGGC | 792 | chr6 | ENST00000429299.2 |
| LTB | UUCAGUCUCAAUGGGGCAC | 793 | chr6 | ENST00000429299.2 |
| LTBP1 | AUGGUGGCCAGUGCAGUUCA | 794 | chr2 | ENST00000407925.5 |
| LTBP1 | GUUUAGGCACGCUGGCACCA | 795 | chr2 | ENST00000407925.5 |
| LTBP1 | GAGGCAAGGUAUGUGUUGAA | 796 | chr2 | ENST00000407925.5 |
| LTBP3 | GCCCUCACCCACGCGGAAGC | 797 | chr11 | ENST00000322147.8 |
| LTBP3 | AUGACGCUCAUCGGAGAGAA | 798 | chr11 | ENST00000322147.8 |
| LTBP3 | CUGCAAGCGGACCUGUCUCA | 799 | chr11 | ENST00000322147.8 |
| LTBP4 | CCCUUGAUCUGUCACAAUGG | 800 | chr19 | ENST00000308370.11 |
| LTBP4 | GGCCGGGGCCGGGCGCCCG | 801 | chr19 | ENST00000308370.11 |
| LTBP4 | GUGCUCGUCGUCGCGGUGGU | 802 | chr19 | ENST00000308370.11 |
| MAF | CAGGAGAAUGGCAUCAGAAC | 803 | chr16 | ENST00000326043.4 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| MAF | CAGGGGACUGGUGGGCAGGU | 804 | chr16 | ENST00000326043.4 |
| MAF | UCCAUGGCCAGGGGACUGGU | 805 | chr16 | ENST00000326043.4 |
| MAF | CGACCUGCCCACCAGUCCCC | 806 | chr16 | ENST00000326043.4 |
| MIF | UUGGUGUUUACGAUGAACAU | 807 | chr22 | ENST00000215754.7 |
| MIF | CAGCAGCUGGCGCAGGCCAC | 808 | chr22 | ENST00000215754.7 |
| MIF | GCGCGGAACCCCUCGUCCGG | 809 | chr22 | ENST00000215754.7 |
| MINOS1- | GGCCACGGGCAUGAUGCUUC | 810 | chr1 | ENST00000602662.1 |
| MINOS1- | GAACAGUGCCAGCUUGUUGA | 811 | chr1 | ENST00000602662.1 |
| MINOS1- | AGCCGCUGUGGCCCACGAUC | 812 | chr1 | ENST00000602662.1 |
| MSTN | UGACGAUUAUCACGCUACAA | 813 | chr2 | ENST00000260950.4 |
| MSTN | UUCCCGGAGUGGAGGAGCUU | 814 | chr2 | ENST00000260950.4 |
| MSTN | AAUCCUCAGUAAACUUCGUC | 815 | chr2 | ENST00000260950.4 |
| NAMPT | GCUGGGGACGAGCGCGCGGC | 816 | chr7 | ENST00000222553.7 |
| NAMPT | CUUUACCUUGUAGGAGUCGG | 817 | chr7 | ENST00000222553.7 |
| NAMPT | CCGGCCCGAGAUGAAUCCUG | 818 | chr7 | ENST00000222553.7 |
| NBL1 | GGCCACGGGCAUGAUGCUUC | 819 | chr1 | ENST00000375136.7 |
| NBL1 | GAACAGUGCCAGCUUGUUGA | 820 | chr1 | ENST00000375136.7 |
| NBL1 | AGCCGCUGUGGCCCACGAUC | 821 | chr1 | ENST00000375136.7 |
| NDP | UUGAGCUACACUUGUACAAU | 822 | chrX | ENST00000378062.5 |
| NDP | CAGCUCAUUCAUAAUGGACU | 823 | chrX | ENST00000378062.5 |
| NDP | CAGCAGGGAGAGCAUAGAAA | 824 | chrX | ENST00000378062.5 |
| NLRP7 | GCCUCUUCCACCUCAGACCA | 825 | chr19 | ENST00000328092.9 |
| NLRP7 | GAGUUUCAAAUCCCUUUUAU | 826 | chr19 | ENST00000328092.9 |
| NLRP7 | CUGCAGAGUCCACUCUAGCU | 827 | chr19 | ENST00000328092.9 |
| NODAL | UGACCAGGCCUCUCUCCAAG | 828 | chr10 | ENST00000287139.7 |
| NODAL | GGGACAAAGUGACAGUGAAU | 829 | chr10 | ENST00000287139.7 |
| NODAL | CUGUGUCGGGCUUUGGCUGG | 830 | chr10 | ENST00000287139.7 |
| NOG | GACCACCACCAGGGCGUAGA | 831 | chr17 | ENST00000332822.4 |
| NOG | GGCGGAUGUGGAGAUAGUGC | 832 | chr17 | ENST00000332822.4 |
| NOG | UUGGGGUCAAAGAUAGGGUC | 833 | chr17 | ENST00000332822.4 |
| NRG1 | GCUACAUCUACAUCCACCAC | 834 | chr8 | ENST00000287842.7 |
| NRG1 | AAACUUUCUGUGUGAAUGGA | 835 | chr8 | ENST00000287842.7 |
| NRG1 | UUACUUGCACAAGUAUCUCG | 836 | chr8 | ENST00000287842.7 |
| NRP1 | UUGCAGAGCAGUGUCUCAGA | 837 | chr10 | ENST00000265371.8 |
| NRP1 | GCUGUCGGUGUAAAAAACCA | 838 | chr10 | ENST00000265371.8 |
| NRP1 | CCACAGUAACGCCCAAUGUG | 839 | chr10 | ENST00000265371.8 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| NRP2 | CUUUCAGACCCACCGUGCGG | 840 | chr2 | ENST00000357785.9 |
| NRP2 | UCUGGUGGGAGGGGUAGUCC | 841 | chr2 | ENST00000357785.9 |
| NRP2 | UUGAGGACAAUCUUCUGGUU | 842 | chr2 | ENST00000357785.9 |
| OSM | AGGGCCCAGGUGCUUACAUA | 843 | chr22 | ENST00000215781.2 |
| OSM | GAUCUGUCUGCUUCUGGAGC | 844 | chr22 | ENST00000215781.2 |
| OSM | GUUUCCAAGCAUGGCGAGCA | 845 | chr22 | ENST00000215781.2 |
| OSMR | AUUACAGCACCACUGUGAAG | 846 | chr5 | ENST00000274276.7 |
| OSMR | CUUUGUAAGAAUAAAGAGUU | 847 | chr5 | ENST00000274276.7 |
| OSMR | GAGCAACUGGAGUUCCUGGG | 848 | chr5 | ENST00000274276.7 |
| PARK7 | UAGAUUAAGGUCACCGUUGC | 849 | chr1 | ENST00000338639.9 |
| PARK7 | CAGGACAAAUGACCACAUCA | 850 | chr1 | ENST00000338639.9 |
| PARK7 | CAUGGAGUUAUUCCUUCAUA | 851 | chr1 | ENST00000338639.9 |
| PDPN | CAACUGCAAAGUUUGCUGUC | 852 | chr1 | ENST00000294489.10 |
| PDPN | CCCCACCGUCGCGCUCCUCC | 853 | chr1 | ENST00000294489.10 |
| PDPN | CAGCUCAGAAUCUUGCUGCU | 854 | chr1 | ENST00000294489.10 |
| PF4 | UGUGAGGGCUGGCAGCGGCG | 855 | chr4 | ENST00000296029.3 |
| PF4 | GUGGCAGGAGCAGCAACCCC | 856 | chr4 | ENST00000296029.3 |
| PF4 | CGCAGCAUGAGCUCCGCAGC | 857 | chr4 | ENST00000296029.3 |
| PF4V1 | GGCGCGGGUGAGGCGGGACC | 858 | chr4 | ENST00000226524.3 |
| PF4V1 | AGAGCAGAAACCAGGCUGGG | 859 | chr4 | ENST00000226524.3 |
| PF4V1 | AGAGCAGAAACCAGGCUGGG | 860 | chr4 | ENST00000226524.3 |
| PGLYRP1 | CGAUACCACCACAUAGCGUA | 861 | chr19 | ENST00000008938.4 |
| PGLYRP1 | CAGGGCCUUCCACUCGUUCC | 862 | chr19 | ENST00000008938.4 |
| PGLYRP1 | GCCGCUCUAUGCUGCUUGCC | 863 | chr19 | ENST00000008938.4 |
| PLP2 | ACCCUUCCAGAUAUUAUGCC | 864 | chrX | ENST00000376327.5 |
| PLP2 | ACCGACAGGGAGGAGUAGCC | 865 | chrX | ENST00000376327.5 |
| PLP2 | GGACCCCUUCUCACACUCCA | 866 | chrX | ENST00000376327.5 |
| PPBP | UUGGCGAAAGGCAAAGGUAG | 867 | chr4 | ENST00000296028.3 |
| PPBP | GUCAUUGCUGCUGACUGCUC | 868 | chr4 | ENST00000296028.3 |
| PPBP | AAGGGGUGGUAUCAAGUCUG | 869 | chr4 | ENST00000296028.3 |
| PXDN | ACCACAGUUCAGCUCUUCCG | 870 | chr2 | ENST00000252804.8 |
| PXDN | GCGUCUGGGAUAUUCACAGA | 871 | chr2 | ENST00000252804.8 |
| PXDN | ACUGCGACUGUGAAAUCCUG | 872 | chr2 | ENST00000252804.8 |
| RORC | CCGCGUUACAGCGCUGGCUC | 873 | chr1 | ENST00000318247.6 |
| RORC | AGUAGGCCGCGUUACAGCGC | 874 | chr1 | ENST00000318247.6 |
| RORC | CUGCUGACGGGUGCAGGAGU | 875 | chr1 | ENST00000318247.6 |
| RORC | GCAGUUCUGCUGACGGGUGC | 876 | chr1 | ENST00000318247.6 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| SCG2 | AGCCCUGAUCAUUUCAGGAC | 877 | chr2 | ENST00000305409.2 |
| SCG2 | CUGGUUCUUUCUGAAGCAGC | 878 | chr2 | ENST00000305409.2 |
| SCG2 | UGGCUGAAGCAAAGACCCAC | 879 | chr2 | ENST00000305409.2 |
| SCGB3A1 | CCUCUAUGAGGUGGUUCACG | 880 | chr5 | ENST00000292641.3 |
| SCGB3A1 | GGUGCCGAGGGGGUUGGCCA | 881 | chr5 | ENST00000292641.3 |
| SCGB3A1 | UGCAGCUGCUGCUUUCUUAG | 882 | chr5 | ENST00000292641.3 |
| SECTM1 | ACAGCCCAGCAUGGGAGUCC | 883 | chr17 | ENST00000269389.7 |
| SECTM1 | CUGGAGCUGCCAGCCGUCCC | 884 | chr17 | ENST00000269389.7 |
| SECTM1 | CUUGAUGUUGACAUGGGAGA | 885 | chr17 | ENST00000269389.7 |
| SLURP1 | CCCUGACUCCAGUGCACCCA | 886 | chr8 | ENST00000246515.1 |
| SLURP1 | CGUCACCAGCGUGGUCAUGC | 887 | chr8 | ENST00000246515.1 |
| SLURP1 | CUUGCAGGUGUAGCACUUGA | 888 | chr8 | ENST00000246515.1 |
| SOSTDC1 | AUCAAGCCAGAAAUGGAGGC | 889 | chr7 | ENST00000307068.4 |
| SOSTDC1 | AGAAAUCCUUUAUUCACAUG | 890 | chr7 | ENST00000307068.4 |
| SOSTDC1 | UUAGGAUGCAUGCAAGGGGA | 891 | chr7 | ENST00000307068.4 |
| SP100 | UCUGAGAGUCCAUUUUCAGG | 892 | chr2 | ENST00000340126.8 |
| SP100 | AGUGACAAAGAUGAUUCGCU | 893 | chr2 | ENST00000340126.8 |
| SP100 | ACCCAGUCAGUCUUACCUGU | 894 | chr2 | ENST00000340126.8 |
| SPI1 | GUCCCCCACAGACCAUUACU | 895 | chr11 | ENST00000378538.7 |
| SPI1 | GGGGGUGGAAGUCCCAGUAA | 896 | chr11 | ENST00000378538.7 |
| SPI1 | CGCUGUGCACGUGGUGGGGG | 897 | chr11 | ENST00000378538.7 |
| SPI1 | ACUCGCUGUGCACGUGGUGG | 898 | chr11 | ENST00000378538.7 |
| SPP1 | AAUGGUGAGACUCAUCAGAC | 899 | chr4 | ENST00000237623.11 |
| SPP1 | UCGGUUGCUGGCAGGUCCGU | 900 | chr4 | ENST00000237623.11 |
| SPP1 | UGAUGGCCGAGGUGAUAGUG | 901 | chr4 | ENST00000237623.11 |
| TBX21 | CCCGCCCCGGAUGGGCAUCG | 902 | ch17 | ENST00000177694.1 |
| TBX21 | GGCAUCGUGGAGCCGGGUUG | 903 | ch17 | ENST00000177694.1 |
| TBX21 | GGGUUGCGGAGACAUGCUGA | 904 | ch17 | ENST00000177694.1 |
| TBX21 | GUCGCUCCCCGGCAUCGGCU | 905 | ch17 | ENST00000177694.1 |
| TCAP | GCACUGCCCCUGCUGGUGGU | 906 | chr17 | ENST00000309889.2 |
| TCAP | AGUACCAGCUGCCCUACCAG | 907 | chr17 | ENST00000309889.2 |
| TCAP | CUCCUUGGUGGCGCCCAUCU | 908 | chr17 | ENST00000309889.2 |
| TGFB1* | GCCGCAGCUUGGACAGGAUC | 909 | chr19 | ENST00000221930.5 |
| TGFB1* | CUCCAUGUCGAUAGUCUUGC | 910 | chr19 | ENST00000221930.5 |
| TGFB1* | AGCAGCCGCAGCCCGGAGGG | 911 | chr19 | ENST00000221930.5 |
| TGFB2* | UACCUGCAGCACACUCGAUA | 912 | chr1 | ENST00000366930.8 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| TGFB2* | UCGGGCUCAGGAUAGUCUUC | 913 | chr1 | ENST00000366930.8 |
| TGFB2* | CUUCUCCUGGAGCAAGUCCC | 914 | chr1 | ENST00000366930.8 |
| TGFB3* | GACAGAUCUUGAGCAAGCUC | 915 | chr14 | ENST00000238682.7 |
| TGFB3* | UGGUGCAAGUGGACAGAGAG | 916 | chr14 | ENST00000238682.7 |
| TGFB3* | GCACUUGCAAAGGGCUCUGG | 917 | chr14 | ENST00000238682.7 |
| TGFBR1** | UUUUCAGUAAAGUCAUCACC | 918 | chr9 | ENST00000374994.8 |
| TGFBR1** | CUGCAUCUCACUCAUGUUGA | 919 | chr9 | ENST00000374994.8 |
| TGFBR1** | CCUCUUCAUUUGGCACUCGA | 920 | chr9 | ENST00000374994.8 |
| TGFBR2** | UCUACUGCUACCGCGUUAAC | 921 | chr3 | ENST00000295754.9 |
| TGFBR2** | CGAGCACUGUGCCAUCAUCC | 922 | chr3 | ENST00000295754.9 |
| TGFBR2** | GUUGAUGUUGUUGGCACACG | 923 | chr3 | ENST00000295754.9 |
| TGFBR3** | CAGCCCAGUUGUGCCUCUGC | 924 | chr1 | ENST00000212355.8 |
| TGFBR3** | CAUCAAGGCCUGGACAGGAU | 925 | chr1 | ENST00000212355.8 |
| TGFBR3** | CCCUUGGCAGGUCCAGAGCC | 926 | chr1 | ENST00000212355.8 |
| THBS1 | UCCUGUCUAACAGAGUCUGG | 927 | chr15 | ENST00000260356.5 |
| THBS1 | GUCGGCGCCCAGACCCCUUG | 928 | chr15 | ENST00000260356.5 |
| THBS1 | UCAGGUUGGCAUCCUCGAUG | 929 | chr15 | ENST00000260356.5 |
| THNSL2 | GAGAAGUGGUCCAUCUGUCC | 930 | chr2 | ENST00000324166.6 |
| THNSL2 | UGGCGUCACAUAUGCAUUUA | 931 | chr2 | ENST00000324166.6 |
| THNSL2 | UCUUCUCCAGGAAGUACUGC | 932 | chr2 | ENST00000324166.6 |
| THPO | CCUGUCCAGAAAGCUGCCCC | 933 | chr3 | ENST00000204615.11 |
| THPO | CCAUCACUCCCUCCAGCAGA | 934 | chr3 | ENST00000204615.11 |
| THPO | UCUUUCUCAGGAGGAGACCA | 935 | chr3 | ENST00000204615.11 |
| TIMP1 | CAGGGGCUCAAAGGGGGCCA | 936 | chrX | ENST00000218388.8 |
| TIMP1 | GACACAGGUGCAGGCCCUGC | 937 | chrX | ENST00000218388.8 |
| TIMP1 | GGGUGAGGACUCACCGAGGU | 938 | chrX | ENST00000218388.8 |
| TNF* | GAUCAUGCUUUCAGUGCUCA | 939 | chr6 | ENST00000449264.2 |
| TNF* | CAAGAAGACAGGGGGGCCCC | 940 | chr6 | ENST00000449264.2 |
| TNF* | GGCGCCUGCCACGAUCAGGA | 941 | chr6 | ENST00000449264.2 |
| TNFRSF4** | CCGGCCCCUGCUCAGGAAGU | 942 | chr1 | ENST00000379236.3 |
| TNFRSF4** | UGAGCGGAAGCAGCUGUGCA | 943 | chr1 | ENST00000379236.3 |
| TNFRSF4** | GCAGCUGUGCACGGCCACAC | 944 | chr1 | ENST00000379236.3 |
| TNFRSF4** | GCGGCAGACUGUGUCCUGUG | 945 | chr1 | ENST00000379236.3 |
| TNFRSF11** | GUCUCCCGCAGGCAAGGCCC | 946 | chr18 | ENST00000586569.2 |
| TNFRSF11** | CCCCCGGCGCUGCGCGUGCA | 947 | chr18 | ENST00000586569.2 |
| TNFRSF11** | CCGCAACACCGAGUGCGCGC | 948 | chr18 | ENST00000586569.2 |
| TNFRSF11** | GCCAGCUGUCUGUGUAGUAG | 949 | chr8 | ENST00000297350.8 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| TNFRSF11** | AACAACACUGUACAGCAAAG | 950 | chr8 | ENST00000297350.8 |
| TNFRSF11** | ACUUUGGAGGAAACGUUUCC | 951 | chr8 | ENST00000297350.8 |
| TNFRSF1A | AGCAAAUCGAAUUAUUUUGA | 952 | chr12 | ENST00000162749.6 |
| TNFRSF1A | UUCUCCCUGUCCCCUAGGUG | 953 | chr12 | ENST00000162749.6 |
| TNFRSF1A | CCAGGUGCUCCUGGAGCUGU | 954 | chr12 | ENST00000162749.6 |
| TNFRSF9** | UGUGAACAGGAUUGUAAACA | 955 | chr1 | ENST00000377507.7 |
| TNFRSF9** | CAGAGUGUGACUGCACUCCA | 956 | chr1 | ENST00000377507.7 |
| TNFRSF9** | GGGACUUUGUAGGUGUUUUC | 957 | chr1 | ENST00000377507.7 |
| TNFSF9*** | GGGGUCCAGUGAAGCGUCAG | 958 | chr19 | ENST00000245817.4 |
| TNFSF9*** | AUACGCCUCUGACGCUUCAC | 959 | chr19 | ENST00000245817.4 |
| TNFSF9*** | CGGGAGGCCACGGGGCUUCG | 960 | chr19 | ENST00000245817.4 |
| TNFSF9*** | CACUGGACCCCGAAGCCCCG | 961 | chr19 | ENST00000245817.4 |
| TNFSF10 | CUACCUUUCUAACGAGCUGA | 962 | chr3 | ENST00000241261.6 |
| TNFSF10 | GUUCAUACUCUCUUCGUCAU | 963 | chr3 | ENST00000241261.6 |
| TNFSF10 | GAAACAAGCAAUGCCACUUU | 964 | chr3 | ENST00000241261.6 |
| TNFSF11 | CCAUCUUCUGAUAUUCUAUU | 965 | chr13 | ENST00000398795.6 |
| TNFSF11 | AGAUUUCAAGACACAACUC | 966 | chr13 | ENST00000398795.6 |
| TNFSF11 | UUCAUGUAGGAGAAUUAAAC | 967 | chr13 | ENST00000398795.6 |
| TNFSF12 | CCGCCCCAUGGCCGCCCGU | 968 | chr17 | ENST00000293825.10 |
| TNFSF12 | CCUGCUGGUCCCGCUCGCGC | 969 | chr17 | ENST00000293825.10 |
| TNFSF12 | CCGGGCAUCGCUGUCCGCCC | 970 | chr17 | ENST00000293825.10 |
| TNFSF12- | CCGCCCCAUGGCCGCCCGU | 971 | chr17 | ENST00000293826.4 |
| TNFSF12- | CCUGCUGGUCCCGCUCGCGC | 972 | chr17 | ENST00000293826.4 |
| TNFSF12- | CCGGGCAUCGCUGUCCGCCC | 973 | chr17 | ENST00000293826.4 |
| TNFSF13 | GGGGGGCCCAGUCAGAGAGC | 974 | chr17 | ENST00000338784.8 |
| TNFSF13 | CAGAGCCAUGGCACAAGCCA | 975 | chr17 | ENST00000338784.8 |
| TNFSF13 | AGAGAGGUGAGCCGGCUGCA | 976 | chr17 | ENST00000338784.8 |
| TNFSF13B | UCAUUUCUUCUCUUUUCUUA | 977 | chr13 | ENST00000375887.8 |
| TNFSF13B | CUCCAAAGACGGAAAGCUGC | 978 | chr13 | ENST00000375887.8 |
| TNFSF13B | CACGGUGGUGUCUUUCUACC | 979 | chr13 | ENST00000375887.8 |
| TNFSF14 | CACACCGCCCAGCUGCACCU | 980 | chr19 | ENST00000599359.1 |
| TNFSF14 | GGGCCCCAUCGUGGUAGCUG | 981 | chr19 | ENST00000599359.1 |
| TNFSF14 | GCUGCCGGUCAAGCUGGAGU | 982 | chr19 | ENST00000599359.1 |
| TNFSF15 | UCAUCCCACGGAAUGUGACC | 983 | chr9 | ENST00000374045.4 |
| TNFSF15 | AUUUGUUGGUAUAGUUCAUU | 984 | chr9 | ENST00000374045.4 |
| TNFSF15 | UGAUUUUUAAAGUGCUGUGU | 985 | chr9 | ENST00000374045.4 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| TNFSF18 | AAUAAAGAUUAGCCAACUGA | 986 | chr1 | ENST00000404377.3 |
| TNFSF18 | GCAAAAGAGCCACAGCUUCC | 987 | chr1 | ENST00000404377.3 |
| TNFSF18 | AAGUGGCUCAAACACAUUUU | 988 | chr1 | ENST00000404377.3 |
| TNFSF4 | CCUCAUCCUUCUGGUAAUGA | 989 | chr1 | ENST00000281834.3 |
| TNFSF4 | GUUUUAUCUCAUCUCCCUGA | 990 | chr1 | ENST00000281834.3 |
| TNFSF4 | CUAGAAUAUAAGAAGGAGAA | 991 | chr1 | ENST00000281834.3 |
| TNFSF8 | UCUGUGCCUUGUCUUCACGG | 992 | chr9 | ENST00000223795.2 |
| TNFSF8 | GCUCGUGGUCCCCAGGUGGC | 993 | chr9 | ENST00000223795.2 |
| TNFSF8 | UGAGUGCUUGCUGCAGCCCU | 994 | chr9 | ENST00000223795.2 |
| TNFSF9 | AUACGCCUCUGACGCUUCAC | 995 | chr19 | ENST00000245817.4 |
| TNFSF9 | ACGCGGCAGGCGCGAGCGCG | 996 | chr19 | ENST00000245817.4 |
| TNFSF9 | CGUCUUCCUCGCCUGCCCCU | 997 | chr19 | ENST00000245817.4 |
| TRIM16 | CUCCUCGGAGAAGCUUGGCA | 998 | chr17 | ENST00000336708.11 |
| TRIM16 | GGUCACCCAGCCCAGAUUCU | 999 | chr17 | ENST00000336708.11 |
| TRIM16 | AGCCUCCCAGAUGGCUGAGU | 1000 | chr17 | ENST00000336708.11 |
| TSLP | UGGAUUUCAGUAAGGCAAUG | 1001 | chr5 | ENST00000344895.3 |
| TSLP | AAUGUUCGCCAUGAAAACUA | 1002 | chr5 | ENST00000344895.3 |
| TSLP | CAAGGUACAGCAAACGUCUG | 1003 | chr5 | ENST00000344895.3 |
| TWSG1 | GUGAGUGCCCGGAAGAGAGA | 1004 | chr18 | ENST00000262120.9 |
| TWSG1 | UGUGAAAGUUCUUCUGCAAC | 1005 | chr18 | ENST00000262120.9 |
| TWSG1 | ACAGACACAUUCUGGUGGUG | 1006 | chr18 | ENST00000262120.9 |
| TXLNA | UAACCAGGGGGCCCCGGCG | 1007 | chr1 | ENST00000373609.1 |
| TXLNA | AGAGAAGUCCCGGACCUAUG | 1008 | chr1 | ENST00000373609.1 |
| TXLNA | UGUGUUUGGAUCCCCCUUGG | 1009 | chr1 | ENST00000373609.1 |
| VASN | GGCAGCUUUGCCGGCCUGCC | 1010 | chr16 | ENST00000304735.3 |
| VASN | ACUCGCCAACCUCAGCAACC | 1011 | chr16 | ENST00000304735.3 |
| VASN | AUGAGACCUUCCGUGGCCUG | 1012 | chr16 | ENST00000304735.3 |
| VEGFA | CAGGGGCCGGAGCCCGCGCC | 1013 | chr6 | ENST00000425836.6 |
| VEGFA | UUCUCGCUUCGGAGGAGCCG | 1014 | chr6 | ENST00000425836.6 |
| VEGFA | AAGUGCUAGCUCGGGCCGGG | 1015 | chr6 | ENST00000425836.6 |
| VSTM1 | CGAAGCUGAAUUCCCCUUCA | 1016 | chr19 | ENST00000338372.6 |
| VSTM1 | UGCGCAAGGUGAACGACUCU | 1017 | chr19 | ENST00000338372.6 |
| VSTM1 | UUCAACCACCGAGCUGGGCC | 1018 | chr19 | ENST00000338372.6 |
| WFIKKN1 | GCUCCUUCUCACAGCGGUCG | 1019 | chr16 | ENST00000319070.2 |
| WFIKKN1 | CCGCUGCUAUAUGGACGCCG | 1020 | chr16 | ENST00000319070.2 |
| WFIKKN1 | CCUGCAAGCACGUGCUCAGC | 1021 | chr16 | ENST00000319070.2 |
| WFIKKN2 | GUGCAAAGACCGCUGUGAGA | 1022 | chr17 | ENST00000311378.4 |

TABLE 10-continued

Additional guide RNA sequences for use in reducing the incidence of CRS

| Target Gene Symbol | Guide RNA Sequence | SEQ ID NO: | Location | Gene ID No. |
|---|---|---|---|---|
| WFIKKN2 | CCGCUGCUACAUGGAUGCCG | 1023 | chr17 | ENST00000311378.4 |
| WFIKKN2 | CCUGCCGCUAUCACUUCACC | 1024 | chr17 | ENST00000311378.4 |
| WNT1 | AGACUCCAAGAGUCUGCAAC | 1025 | chr12 | ENST00000293549.3 |
| WNT1 | GCGUCUGAUACGCCAAAAUC | 1026 | chr12 | ENST00000293549.3 |
| WNT1 | GGCAGUUCCGGAAUCGCCGC | 1027 | chr12 | ENST00000293549.3 |
| WNT2 | UGUUGCAAUUCCAGCGGUGC | 1028 | chr7 | ENST00000265441.7 |
| WNT2 | CUAAUGGCACGCAUCACAUC | 1029 | chr7 | ENST00000265441.7 |
| WNT2 | GAGCUACAGGUGGCUCCUCC | 1030 | chr7 | ENST00000265441.7 |
| WNT5A | UGCAGUUCCACCUUCGAUGU | 1031 | chr3 | ENST00000264634.8 |
| WNT5A | CUUCUCCGAUGUACUGCAUG | 1032 | chr3 | ENST00000264634.8 |
| WNT5A | CCUGCCAGUUGGCUGCAGAG | 1033 | chr3 | ENST00000264634.8 |
| WNT7A | AGAGCGCACCGUCUUCGGGA | 1034 | chr3 | ENST00000285018.4 |
| WNT7A | ACUGAAACUGACACUCGUCC | 1035 | chr3 | ENST00000285018.4 |
| WNT7A | UGGCAGAUCGCCCGCUGUCU | 1036 | chr3 | ENST00000285018.4 |
| XCL1* | GGAGUGAAGUCUCAGAUAAG | 1037 | chr1 | ENST00000367818.3 |
| XCL1* | GGAGUGAAGUCUCAGAUAAG | 1038 | chr1 | ENST00000367818.3 |
| XCL1* | GGAGUGAAGUCUCAGAUAAG | 1039 | chr1 | ENST00000367818.3 |
| XCL2* | GAGUGUAUUUCUAUACCUCU | 1040 | chr1 | ENST00000367819.2 |
| XCL2* | UAGGGAGUGAAGUCUCACAU | 1041 | chr1 | ENST00000367819.2 |
| XCL2* | UAGGGAGUGAAGUCUCACAU | 1042 | chr1 | ENST00000367819.2 |
| ZFP36 | CCUCCAUGGUCGGAUGGCAC | 1043 | chr19 | ENST00000597629.1 |
| ZFP36 | UCGGAGGGGCUCAGGCUCCA | 1044 | chr19 | ENST00000597629.1 |
| ZFP36 | GGAGGGCCGCAGCUGUGGCU | 1045 | chr19 | ENST00000597629.1 |

*indicates cytokines/chemokines produced by T cells that activate or localize myeloid cells
**indicates T cell surface receptor genes that activate myeloid or CAR-T cells
***indicates T cell surface receptors that are integrated into CAR-T cell signaling thus endogenous receptors are redundant
^indicates cytokines that drive T cell/CAR-T cell differentiation
Bold rows indicate transcription factors that drive T cell/CAR-T cell differentiation Example 6-Protocol-Nucleofection Using Nucleofector 4D $4 \times 10^6$ cells per reaction are used. EO-115-100 µl transfection volume is programmed, and the entire supplement added to the Nucleofector™ Solution P3. Cell culture plates are prepared by filling appropriate number of wells with desired volume of recommended culture media (2 ml in 6 well plate) and pre-incubating/equilibrating plates in a humidified 37° C./5% $CO_2$ incubator. Beads are magnetically removed (twice to ensure complete removal), then cells counted and cell density determined. The required number of cells are centrifuged at 90×g for 10 minutes at room temperature, the supernatant removed completely. Cells are then resuspended in PBS (1 ml) and transferred to a microcentrifuge tube, and the required number of cells centrifuged at 90×g for 10 minutes at room temperature. The supernatant is removed completely, and the cell pellet resuspended carefully in complete room temperature 4D Nucleofector™ Solution P3, $4 \times 10^6$ per 100 µl). Twenty µg of gRNA (gGM-CSF) is added to each tube of 15 µg Cas9 mRNA. Then 100 µl of cells is added to each tube of Cas9/gRNA, gently mixed and everything transferred into the Nucleocuvette™. The cuvette is gently tapped to remove bubbles. Electroporation is carried out using program (Human T cell stim EO-115). After run completion, the Nucleocuvette™ is carefully removed from the vessel from the retainer using a specialized tool. Cells are resuspended with pre-warmed medium. The media is then taken up from destination well, added to cuvette, and gently pipetted up and down two to three times. This is then transferred to well. This procedure is repeated with media from same well and incubated at 37° C.

CAR Transduction (Day 2).

Genome-edited CAR-T cells may then be transduced with one or more CARs targeted to (i.e., that recognizes) one or more targets, for example with a lentivirus containing a CAR construct. Any other suitable method of transduction may be used.

Protocol—To transduce T cells with lentivirus: One μl of polybrene is added for each ml media (8 mg/ml stock). The required amount of virus is then added to give required M.O.I. Cells and virus are mixed and placed back in incubator at 37° C.

Assessment of Transduction Efficiency (Day 10).

Samples of cells may then be assessed for transduction efficiency by taking a $5 \times 10^5$ cells from each sample and analyzing by flow cytometry. Samples are washed with RB, and 3 μl of anti-CD34 PE antibody added (to detect the CAR as the construct contains human truncated CD34). Thereafter, 5 μl of CD3 APC is added, the cells washed, and flow cytometry performed. CAR-T cells should be CD38 positive, CD34 positive.

Assessment of Genetic Deletion.

To assess genetic deletion, $5 \times 10^5$ cells are harvested from each sample and their DNA extracted. Gene editing efficiency is assessed using target sequencing of the target loci using TIDE-analysis or deep sequencing.

Assessment of Tumor Burden and Cytokine Level.

T cells are harvested (Day 11). Tumor burden may be imaged in mouse using bioluminescent imaging. $3 \times 10^7$ CAR-T are injected per mouse I.P.

Serum cytokine levels (Day 12) are measured, e.g., using the Luminex multiplex cytokine profiling assay to check for elevations in CRS-related cytokines. A 4-hr chromium release assay against targets cells (Raji) may be performed to assess in vitro activity (Day 11).

Example 7—Additional Examples of CAR-Bearing Immune Effector Cells

Several types of chimeric antigen receptor (CAR)-bearing immune effector cells that are deficient in a cytokine may be made using the methods above. Tables 11-13 below give Examples.

TABLE 11

| Example | Cell | Mono, Dual, or Tandem | CAR Target(s) | Antigen Deletion(s) | TCR Modifications | Gene Deleted/ Suppressed |
|---|---|---|---|---|---|---|
| 1 | T-Cell | Mono | CD19 | — | — | GM-CSF |
| 2 | T-Cell | Mono | CD19 | — | — | CCL2 |
| 3 | T-Cell | Mono | CD19 | — | — | MCP-2 |
| 4 | T-Cell | Mono | CD19 | — | — | G-CSF |
| 5 | T-Cell | Mono | CD19 | — | — | M-CSF |
| 6 | T-Cell | Mono | CD19 | — | — | Il-4 |
| 7 | T-Cell | Mono | CD19 | — | — | IFNγ |
| 8 | T-Cell | Mono | CD19 | — | TRAC | GM-CSF |
| 9 | T-Cell | Mono | CD19 | — | TRAC | CCL2 |
| 10 | T-Cell | Mono | CD19 | — | TRAC | MCP-2 |
| 11 | T-Cell | Mono | CD19 | — | TRAC | G-CSF |
| 12 | T-Cell | Mono | CD19 | — | TRAC | M-CSF |
| 13 | T-Cell | Mono | CD19 | — | TRAC | Il-4 |
| 14 | T-Cell | Mono | CD19 | — | TRAC | IFNγ |
| 15 | T-Cell | Mono | CD20 | — | — | GM-CSF |
| 16 | T-Cell | Mono | CD20 | — | — | CCL2 |
| 17 | T-Cell | Mono | CD20 | — | — | MCP-2 |
| 18 | T-Cell | Mono | CD20 | — | — | G-CSF |
| 19 | T-Cell | Mono | CD20 | — | — | M-CSF |
| 20 | T-Cell | Mono | CD20 | — | — | Il-4 |
| 21 | T-Cell | Mono | CD20 | — | — | IFNγ |
| 22 | T-Cell | Mono | CD20 | — | TRAC | GM-CSF |
| 23 | T-Cell | Mono | CD20 | — | TRAC | CCL2 |
| 24 | T-Cell | Mono | CD20 | — | TRAC | MCP-2 |
| 25 | T-Cell | Mono | CD20 | — | TRAC | G-CSF |
| 26 | T-Cell | Mono | CD20 | — | TRAC | M-CSF |
| 27 | T-Cell | Mono | CD20 | — | TRAC | Il-4 |
| 28 | T-Cell | Mono | CD20 | — | TRAC | IFNγ |
| 29 | T-Cell | Mono | BCMA | — | — | GM-CSF |
| 30 | T-Cell | Mono | BCMA | — | — | CCL2 |
| 31 | T-Cell | Mono | BCMA | — | — | MCP-2 |
| 32 | T-Cell | Mono | BCMA | — | — | G-CSF |
| 33 | T-Cell | Mono | BCMA | — | — | M-CSF |
| 34 | T-Cell | Mono | BCMA | — | — | Il-4 |
| 35 | T-Cell | Mono | BCMA | — | — | IFNγ |
| 36 | T-Cell | Mono | BCMA | — | TRAC | GM-CSF |
| 37 | T-Cell | Mono | BCMA | — | TRAC | CCL2 |
| 38 | T-Cell | Mono | BCMA | — | TRAC | MCP-2 |
| 39 | T-Cell | Mono | BCMA | — | TRAC | G-CSF |
| 40 | T-Cell | Mono | BCMA | — | TRAC | M-CSF |
| 41 | T-Cell | Mono | BCMA | — | TRAC | Il-4 |
| 42 | T-Cell | Mono | BCMA | — | TRAC | IFNγ |
| 43 | T-Cell | Mono | Mesothelin | — | — | GM-CSF |
| 44 | T-Cell | Mono | Mesothelin | — | — | CCL2 |
| 45 | T-Cell | Mono | Mesothelin | — | — | MCP-2 |
| 46 | T-Cell | Mono | Mesothelin | — | — | G-CSF |
| 47 | T-Cell | Mono | Mesothelin | — | — | M-CSF |
| 48 | T-Cell | Mono | Mesothelin | — | — | Il-4 |
| 49 | T-Cell | Mono | Mesothelin | — | — | IFNγ |

TABLE 11-continued

| Example | Cell | Mono, Dual, or Tandem | CAR Target(s) | Antigen Deletion(s) | TCR Modifications | Gene Deleted/ Suppressed |
|---|---|---|---|---|---|---|
| 50 | T-Cell | Mono | Mesothelin | — | TRAC | GM-CSF |
| 51 | T-Cell | Mono | Mesothelin | — | TRAC | CCL2 |
| 52 | T-Cell | Mono | Mesothelin | — | TRAC | MCP-2 |
| 53 | T-Cell | Mono | Mesothelin | — | TRAC | G-CSF |
| 54 | T-Cell | Mono | Mesothelin | — | TRAC | M-CSF |
| 55 | T-Cell | Mono | Mesothelin | — | TRAC | Il-4 |
| 56 | T-Cell | Mono | Mesothelin | — | TRAC | IFNγ |
| 57 | T-Cell | Mono | CD7 | CD7 | TRAC | GM-CSF |
| 58 | T-Cell | Mono | CD7 | CD7 | TRAC | CCL2 |
| 59 | T-Cell | Mono | CD7 | CD7 | TRAC | MCP-2 |
| 60 | T-Cell | Mono | CD7 | CD7 | TRAC | G-CSF |
| 61 | T-Cell | Mono | CD7 | CD7 | TRAC | M-CSF |
| 62 | T-Cell | Mono | CD7 | CD7 | TRAC | Il-4 |
| 63 | T-Cell | Mono | CD7 | CD7 | TRAC | IFNγ |
| 64 | T-Cell | Mono | CD3ε | CD3ε | — | GM-CSF |
| 65 | T-Cell | Mono | CD3ε | CD3ε | — | CCL2 |
| 66 | T-Cell | Mono | CD3ε | CD3ε | — | MCP-2 |
| 67 | T-Cell | Mono | CD3ε | CD3ε | — | G-CSF |
| 68 | T-Cell | Mono | CD3ε | CD3ε | — | M-CSF |
| 69 | T-Cell | Mono | CD3ε | CD3ε | — | Il-4 |
| 70 | T-Cell | Mono | CD3ε | CD3ε | — | IFNγ |
| 71 | T-Cell | Mono | CD2 | CD2 | TRAC | GM-CSF |
| 72 | T-Cell | Mono | CD2 | CD2 | TRAC | CCL2 |
| 73 | T-Cell | Mono | CD2 | CD2 | TRAC | MCP-2 |
| 74 | T-Cell | Mono | CD2 | CD2 | TRAC | G-CSF |
| 75 | T-Cell | Mono | CD2 | CD2 | TRAC | M-CSF |
| 76 | T-Cell | Mono | CD2 | CD2 | TRAC | Il-4 |
| 77 | T-Cell | Mono | CD2 | CD2 | TRAC | IFNγ |
| 78 | T-Cell | Mono | CD5 | — | TRAC | GM-CSF |
| 79 | T-Cell | Mono | CD5 | — | TRAC | CCL2 |
| 80 | T-Cell | Mono | CD5 | — | TRAC | MCP-2 |
| 81 | T-Cell | Mono | CD5 | — | TRAC | G-CSF |
| 82 | T-Cell | Mono | CD5 | — | TRAC | M-CSF |
| 83 | T-Cell | Mono | CD5 | — | TRAC | Il-4 |
| 84 | T-Cell | Mono | CD5 | — | TRAC | IFNγ |
| 85 | T-Cell | Mono | CD5 | CD5 | TRAC | GM-CSF |
| 86 | T-Cell | Mono | CD5 | CD5 | TRAC | CCL2 |
| 87 | T-Cell | Mono | CD5 | CD5 | TRAC | MCP-2 |
| 88 | T-Cell | Mono | CD5 | CD5 | TRAC | G-CSF |
| 89 | T-Cell | Mono | CD5 | CD5 | TRAC | M-CSF |
| 90 | T-Cell | Mono | CD5 | CD5 | TRAC | Il-4 |
| 91 | T-Cell | Mono | CD5 | CD5 | TRAC | IFNγ |
| 92 | T-Cell | Tandem | CD7 × CD2 | CD7 & CD2 | TRAC | GM-CSF |
| 93 | T-Cell | Tandem | CD7 × CD2 | CD7 & CD2 | TRAC | CCL2 |
| 94 | T-Cell | Tandem | CD7 × CD2 | CD7 & CD2 | TRAC | MCP-2 |
| 95 | T-Cell | Tandem | CD7 × CD2 | CD7 & CD2 | TRAC | G-CSF |
| 96 | T-Cell | Tandem | CD7 × CD2 | CD7 & CD2 | TRAC | M-CSF |
| 97 | T-Cell | Tandem | CD7 × CD2 | CD7 & CD2 | TRAC | Il-4 |
| 98 | T-Cell | Tandem | CD7 × CD2 | CD7 & CD2 | TRAC | IFNγ |
| 99 | T-Cell | Tandem | CD3ε × CD2 | CD3 & CD2 | — | GM-CSF |
| 100 | T-Cell | Tandem | CD3ε × CD2 | CD3 & CD2 | — | CCL2 |
| 101 | T-Cell | Tandem | CD3ε × CD2 | CD3 & CD2 | — | MCP-2 |
| 102 | T-Cell | Tandem | CD3ε × CD2 | CD3 & CD2 | — | G-CSF |
| 103 | T-Cell | Tandem | CD3ε × CD2 | CD3 & CD2 | — | M-CSF |
| 104 | T-Cell | Tandem | CD3ε × CD2 | CD3 & CD2 | — | Il-4 |
| 105 | T-Cell | Tandem | CD3ε × CD2 | CD3 & CD2 | — | IFNγ |
| 106 | T-Cell | Tandem | CD19 × CD20 | — | TRAC | GM-CSF |
| 107 | T-Cell | Tandem | CD19 × CD20 | — | TRAC | CCL2 |
| 108 | T-Cell | Tandem | CD19 × CD20 | — | TRAC | MCP-2 |
| 109 | T-Cell | Tandem | CD19 × CD20 | — | TRAC | G-CSF |
| 110 | T-Cell | Tandem | CD19 × CD20 | — | TRAC | M-CSF |
| 111 | T-Cell | Tandem | CD19 × CD20 | — | TRAC | Il-4 |
| 112 | T-Cell | Tandem | CD19 × CD20 | — | TRAC | IFNγ |
| 113 | T-Cell | Dual | CD7 × CD2 | CD7 & CD2 | TRAC | GM-CSF |
| 114 | T-Cell | Dual | CD7 × CD2 | CD7 & CD2 | TRAC | CCL2 |
| 115 | T-Cell | Dual | CD7 × CD2 | CD7 & CD2 | TRAC | MCP-2 |
| 116 | T-Cell | Dual | CD7 × CD2 | CD7 & CD2 | TRAC | G-CSF |
| 117 | T-Cell | Dual | CD7 × CD2 | CD7 & CD2 | TRAC | M-CSF |
| 118 | T-Cell | Dual | CD7 × CD2 | CD7 & CD2 | TRAC | Il-4 |
| 119 | T-Cell | Dual | CD7 × CD2 | CD7 & CD2 | TRAC | IFNγ |
| 120 | T-Cell | Dual | CD3ε × CD2 | CD3 & CD2 | — | GM-CSF |
| 121 | T-Cell | Dual | CD3ε × CD2 | CD3 & CD2 | — | CCL2 |
| 122 | T-Cell | Dual | CD3ε × CD2 | CD3 & CD2 | — | MCP-2 |
| 123 | T-Cell | Dual | CD3ε × CD2 | CD3 & CD2 | — | G-CSF |
| 124 | T-Cell | Dual | CD3ε × CD2 | CD3 & CD2 | — | M-CSF |
| 125 | T-Cell | Dual | CD3ε × CD2 | CD3 & CD2 | — | Il-4 |

TABLE 11-continued

| Example | Cell | Mono, Dual, or Tandem | CAR Target(s) | Antigen Deletion(s) | TCR Modifications | Gene Deleted/Suppressed |
|---|---|---|---|---|---|---|
| 126 | T-Cell | Dual | CD3ε × CD2 | CD3 & CD2 | — | IFNγ |
| 127 | T-Cell | Dual | CD19 × CD20 | — | TRAC | GM-CSF |
| 128 | T-Cell | Dual | CD19 × CD20 | — | TRAC | CCL2 |
| 129 | T-Cell | Dual | CD19 × CD20 | — | TRAC | MCP-2 |
| 130 | T-Cell | Dual | CD19 × CD20 | — | TRAC | G-CSF |
| 131 | T-Cell | Dual | CD19 × CD20 | — | TRAC | M-CSF |
| 132 | T-Cell | Dual | CD19 × CD20 | — | TRAC | Il-4 |
| 133 | T-Cell | Dual | CD19 × CD20 | — | TRAC | IFNγ |

TABLE 12

| Example | Cell | Mono, Dual, or Tandem | CAR Target(s) | Antigen Deletion(s) | Gene Deleted/Suppressed |
|---|---|---|---|---|---|
| 134 | NK Cell | Mono | CD19 | — | GM-CSF |
| 135 | NK Cell | Mono | CD19 | — | CCL2 |
| 136 | NK Cell | Mono | CD19 | — | MCP-2 |
| 137 | NK Cell | Mono | CD19 | — | G-CSF |
| 138 | NK Cell | Mono | CD19 | — | M-CSF |
| 139 | NK Cell | Mono | CD19 | — | Il-4 |
| 140 | NK Cell | Mono | CD19 | — | IFNγ |
| 141 | NK Cell | Mono | CD19 | — | GM-CSF |
| 142 | NK Cell | Mono | CD19 | — | CCL2 |
| 143 | NK Cell | Mono | CD19 | — | MCP-2 |
| 144 | NK Cell | Mono | CD19 | — | G-CSF |
| 145 | NK Cell | Mono | CD19 | — | M-CSF |
| 146 | NK Cell | Mono | CD19 | — | Il-4 |
| 147 | NK Cell | Mono | CD19 | — | IFNγ |
| 148 | NK Cell | Mono | CD20 | — | GM-CSF |
| 149 | NK Cell | Mono | CD20 | — | CCL2 |
| 150 | NK Cell | Mono | CD20 | — | MCP-2 |
| 151 | NK Cell | Mono | CD20 | — | G-CSF |
| 152 | NK Cell | Mono | CD20 | — | M-CSF |
| 153 | NK Cell | Mono | CD20 | — | Il-4 |
| 154 | NK Cell | Mono | CD20 | — | IFNγ |
| 155 | NK Cell | Mono | CD20 | — | GM-CSF |
| 156 | NK Cell | Mono | CD20 | — | CCL2 |
| 157 | NK Cell | Mono | CD20 | — | MCP-2 |
| 158 | NK Cell | Mono | CD20 | — | G-CSF |
| 159 | NK Cell | Mono | CD20 | — | M-CSF |
| 160 | NK Cell | Mono | CD20 | — | Il-4 |
| 161 | NK Cell | Mono | CD20 | — | IFNγ |
| 162 | NK Cell | Mono | BCMA | — | GM-CSF |
| 163 | NK Cell | Mono | BCMA | — | CCL2 |
| 164 | NK Cell | Mono | BCMA | — | MCP-2 |
| 165 | NK Cell | Mono | BCMA | — | G-CSF |
| 166 | NK Cell | Mono | BCMA | — | M-CSF |
| 167 | NK Cell | Mono | BCMA | — | Il-4 |
| 168 | NK Cell | Mono | BCMA | — | IFNγ |
| 169 | NK Cell | Mono | BCMA | — | GM-CSF |
| 170 | NK Cell | Mono | BCMA | — | CCL2 |
| 171 | NK Cell | Mono | BCMA | — | MCP-2 |
| 172 | NK Cell | Mono | BCMA | — | G-CSF |
| 173 | NK Cell | Mono | BCMA | — | M-CSF |
| 174 | NK Cell | Mono | BCMA | — | Il-4 |
| 175 | NK Cell | Mono | BCMA | — | IFNγ |
| 176 | NK Cell | Mono | Mesothelin | — | GM-CSF |
| 177 | NK Cell | Mono | Mesothelin | — | CCL2 |
| 178 | NK Cell | Mono | Mesothelin | — | MCP-2 |
| 179 | NK Cell | Mono | Mesothelin | — | G-CSF |
| 180 | NK Cell | Mono | Mesothelin | — | M-CSF |
| 181 | NK Cell | Mono | Mesothelin | — | Il-4 |
| 182 | NK Cell | Mono | Mesothelin | — | IFNγ |
| 183 | NK Cell | Mono | Mesothelin | — | GM-CSF |
| 184 | NK Cell | Mono | Mesothelin | — | CCL2 |
| 185 | NK Cell | Mono | Mesothelin | — | MCP-2 |
| 186 | NK Cell | Mono | Mesothelin | — | G-CSF |
| 187 | NK Cell | Mono | Mesothelin | — | M-CSF |
| 188 | NK Cell | Mono | Mesothelin | — | Il-4 |
| 189 | NK Cell | Mono | Mesothelin | — | IFNγ |
| 190 | NK Cell | Mono | CD7 | CD7 | GM-CSF |
| 191 | NK Cell | Mono | CD7 | CD7 | CCL2 |
| 192 | NK Cell | Mono | CD7 | CD7 | MCP-2 |
| 193 | NK Cell | Mono | CD7 | CD7 | G-CSF |
| 194 | NK Cell | Mono | CD7 | CD7 | M-CSF |
| 195 | NK Cell | Mono | CD7 | CD7 | Il-4 |
| 196 | NK Cell | Mono | CD7 | CD7 | IFNγ |
| 197 | NK Cell | Mono | CD3ε | CD3ε | GM-CSF |
| 198 | NK Cell | Mono | CD3ε | CD3ε | CCL2 |
| 199 | NK Cell | Mono | CD3ε | CD3ε | MCP-2 |
| 200 | NK Cell | Mono | CD3ε | CD3ε | G-CSF |
| 201 | NK Cell | Mono | CD3ε | CD3ε | M-CSF |
| 202 | NK Cell | Mono | CD3ε | CD3ε | Il-4 |
| 203 | NK Cell | Mono | CD3ε | CD3ε | IFNγ |
| 204 | NK Cell | Mono | CD2 | CD2 | GM-CSF |
| 205 | NK Cell | Mono | CD2 | CD2 | CCL2 |
| 206 | NK Cell | Mono | CD2 | CD2 | MCP-2 |
| 207 | NK Cell | Mono | CD2 | CD2 | G-CSF |
| 208 | NK Cell | Mono | CD2 | CD2 | M-CSF |
| 209 | NK Cell | Mono | CD2 | CD2 | Il-4 |
| 210 | NK Cell | Mono | CD2 | CD2 | IFNγ |
| 211 | NK Cell | Mono | CD5 | — | GM-CSF |
| 212 | NK Cell | Mono | CD5 | — | CCL2 |
| 213 | NK Cell | Mono | CD5 | — | MCP-2 |
| 214 | NK Cell | Mono | CD5 | — | G-CSF |
| 215 | NK Cell | Mono | CD5 | — | M-CSF |
| 216 | NK Cell | Mono | CD5 | — | Il-4 |
| 217 | NK Cell | Mono | CD5 | — | IFNγ |
| 218 | NK Cell | Tandem | CD7xCD2 | CD7 & CD2 | GM-CSF |
| 219 | NK Cell | Tandem | CD7xCD2 | CD7 & CD2 | CCL2 |
| 220 | NK Cell | Tandem | CD7xCD2 | CD7 & CD2 | MCP-2 |
| 221 | NK Cell | Tandem | CD7xCD2 | CD7 & CD2 | G-CSF |
| 222 | NK Cell | Tandem | CD7xCD2 | CD7 & CD2 | M-CSF |
| 223 | NK Cell | Tandem | CD7xCD2 | CD7 & CD2 | Il-4 |
| 224 | NK Cell | Tandem | CD7xCD2 | CD7 & CD2 | IFNγ |
| 225 | NK Cell | Tandem | CD3εxCD2 | CD3 & CD2 | GM-CSF |
| 226 | NK Cell | Tandem | CD3εxCD2 | CD3 & CD2 | CCL2 |
| 227 | NK Cell | Tandem | CD3εxCD2 | CD3 & CD2 | MCP-2 |
| 228 | NK Cell | Tandem | CD3εxCD2 | CD3 & CD2 | G-CSF |
| 229 | NK Cell | Tandem | CD3εxCD2 | CD3 & CD2 | M-CSF |
| 230 | NK Cell | Tandem | CD3εxCD2 | CD3 & CD2 | Il-4 |
| 231 | NK Cell | Tandem | CD3εxCD2 | CD3 & CD2 | IFNγ |
| 232 | NK Cell | Tandem | CD19xCD20 | — | GM-CSF |
| 233 | NK Cell | Tandem | CD19xCD20 | — | CCL2 |
| 234 | NK Cell | Tandem | CD19xCD20 | — | MCP-2 |
| 235 | NK Cell | Tandem | CD19xCD20 | — | G-CSF |
| 236 | NK Cell | Tandem | CD19xCD20 | — | M-CSF |
| 237 | NK Cell | Tandem | CD19xCD20 | — | Il-4 |
| 238 | NK Cell | Tandem | CD19xCD20 | — | IFNγ |
| 239 | NK Cell | Dual | CD7xCD2 | CD7 & CD2 | GM-CSF |
| 240 | NK Cell | Dual | CD7xCD2 | CD7 & CD2 | CCL2 |
| 241 | NK Cell | Dual | CD7xCD2 | CD7 & CD2 | MCP-2 |
| 242 | NK Cell | Dual | CD7xCD2 | CD7 & CD2 | G-CSF |
| 243 | NK Cell | Dual | CD7xCD2 | CD7 & CD2 | M-CSF |
| 244 | NK Cell | Dual | CD7xCD2 | CD7 & CD2 | Il-4 |
| 245 | NK Cell | Dual | CD7xCD2 | CD7 & CD2 | IFNγ |
| 246 | NK Cell | Dual | CD3εxCD2 | CD3 & CD2 | GM-CSF |
| 247 | NK Cell | Dual | CD3εxCD2 | CD3 & CD2 | CCL2 |
| 248 | NK Cell | Dual | CD3εxCD2 | CD3 & CD2 | MCP-2 |
| 249 | NK Cell | Dual | CD3εxCD2 | CD3 & CD2 | G-CSF |

TABLE 12-continued

| Example | Cell | Mono, Dual, or Tandem | CAR Target(s) | Antigen Deletion(s) | Gene Deleted/ Suppressed |
|---|---|---|---|---|---|
| 250 | NK Cell | Dual | CD3εxCD2 | CD3 & CD2 | M-CSF |
| 251 | NK Cell | Dual | CD3εxCD2 | CD3 & CD2 | Il-4 |
| 252 | NK Cell | Dual | CD3εxCD2 | CD3 & CD2 | IFNγ |
| 253 | NK Cell | Dual | CD19xCD20 | — | GM-CSF |
| 254 | NK Cell | Dual | CD19xCD20 | — | CCL2 |
| 255 | NK Cell | Dual | CD19xCD20 | — | MCP-2 |
| 256 | NK Cell | Dual | CD19xCD20 | — | G-CSF |
| 257 | NK Cell | Dual | CD19xCD20 | — | M-CSF |
| 258 | NK Cell | Dual | CD19xCD20 | — | Il-4 |
| 259 | NK Cell | Dual | CD19xCD20 | — | IFNγ |

TABLE 13

| Example | Cell | Mono, Dual, or Tandem | CAR Target(s) | Antigen Deletion(s) | Gene Deleted/ Suppressed |
|---|---|---|---|---|---|
| 260 | iNKT | Mono | CD19 | — | GM-CSF |
| 261 | iNKT | Mono | CD19 | — | CCL2 |
| 262 | iNKT | Mono | CD19 | — | MCP-2 |
| 263 | iNKT | Mono | CD19 | — | G-CSF |
| 264 | iNKT | Mono | CD19 | — | M-CSF |
| 265 | iNKT | Mono | CD19 | — | Il-4 |
| 266 | iNKT | Mono | CD19 | — | IFNγ |
| 267 | iNKT | Mono | CD19 | — | GM-CSF |
| 268 | iNKT | Mono | CD19 | — | CCL2 |
| 269 | iNKT | Mono | CD19 | — | MCP-2 |
| 270 | iNKT | Mono | CD19 | — | G-CSF |
| 271 | iNKT | Mono | CD19 | — | M-CSF |
| 272 | iNKT | Mono | CD19 | — | Il-4 |
| 273 | iNKT | Mono | CD19 | — | IFNγ |
| 274 | iNKT | Mono | CD20 | — | GM-CSF |
| 275 | iNKT | Mono | CD20 | — | CCL2 |
| 276 | iNKT | Mono | CD20 | — | MCP-2 |
| 277 | iNKT | Mono | CD20 | — | G-CSF |
| 278 | iNKT | Mono | CD20 | — | M-CSF |
| 279 | iNKT | Mono | CD20 | — | Il-4 |
| 280 | iNKT | Mono | CD20 | — | IFNγ |
| 281 | iNKT | Mono | CD20 | — | GM-CSF |
| 282 | iNKT | Mono | CD20 | — | CCL2 |
| 283 | iNKT | Mono | CD20 | — | MCP-2 |
| 284 | iNKT | Mono | CD20 | — | G-CSF |
| 285 | iNKT | Mono | CD20 | — | M-CSF |
| 286 | iNKT | Mono | CD20 | — | Il-4 |
| 287 | iNKT | Mono | CD20 | — | IFNγ |
| 288 | iNKT | Mono | BCMA | — | GM-CSF |
| 289 | iNKT | Mono | BCMA | — | CCL2 |
| 290 | iNKT | Mono | BCMA | — | MCP-2 |
| 291 | iNKT | Mono | BCMA | — | G-CSF |
| 292 | iNKT | Mono | BCMA | — | M-CSF |
| 293 | iNKT | Mono | BCMA | — | Il-4 |
| 294 | iNKT | Mono | BCMA | — | IFNγ |
| 295 | iNKT | Mono | BCMA | — | GM-CSF |
| 296 | iNKT | Mono | BCMA | — | CCL2 |
| 297 | iNKT | Mono | BCMA | — | MCP-2 |
| 298 | iNKT | Mono | BCMA | — | G-CSF |
| 299 | iNKT | Mono | BCMA | — | M-CSF |
| 300 | iNKT | Mono | BCMA | — | Il-4 |
| 301 | iNKT | Mono | BCMA | — | IFNγ |
| 302 | iNKT | Mono | Mesothelin | — | GM-CSF |
| 303 | iNKT | Mono | Mesothelin | — | CCL2 |
| 304 | iNKT | Mono | Mesothelin | — | MCP-2 |
| 305 | iNKT | Mono | Mesothelin | — | G-CSF |
| 306 | iNKT | Mono | Mesothelin | — | M-CSF |
| 307 | iNKT | Mono | Mesothelin | — | Il-4 |
| 308 | iNKT | Mono | Mesothelin | — | IFNγ |
| 309 | iNKT | Mono | Mesothelin | — | GM-CSF |
| 310 | iNKT | Mono | Mesothelin | — | CCL2 |
| 311 | iNKT | Mono | Mesothelin | — | MCP-2 |
| 312 | iNKT | Mono | Mesothelin | — | G-CSF |
| 313 | iNKT | Mono | Mesothelin | — | M-CSF |
| 314 | iNKT | Mono | Mesothelin | — | Il-4 |
| 315 | iNKT | Mono | Mesothelin | — | IFNγ |

TABLE 13-continued

| Example | Cell | Mono, Dual, or Tandem | CAR Target(s) | Antigen Deletion(s) | Gene Deleted/ Suppressed |
|---|---|---|---|---|---|
| 316 | iNKT | Mono | CD7 | CD7 | GM-CSF |
| 317 | iNKT | Mono | CD7 | CD7 | CCL2 |
| 318 | iNKT | Mono | CD7 | CD7 | MCP-2 |
| 319 | iNKT | Mono | CD7 | CD7 | G-CSF |
| 320 | iNKT | Mono | CD7 | CD7 | M-CSF |
| 321 | iNKT | Mono | CD7 | CD7 | Il-4 |
| 322 | iNKT | Mono | CD7 | CD7 | IFNγ |
| 323 | iNKT | Mono | CD3ε | CD3ε | GM-CSF |
| 324 | iNKT | Mono | CD3ε | CD3ε | CCL2 |
| 325 | iNKT | Mono | CD3ε | CD3ε | MCP-2 |
| 326 | iNKT | Mono | CD3ε | CD3ε | G-CSF |
| 327 | iNKT | Mono | CD3ε | CDε | M-CSF |
| 328 | iNKT | Mono | CD3ε | CD3ε | Il-4 |
| 329 | iNKT | Mono | CD3ε | CD3ε | IFNγ |
| 330 | iNKT | Mono | CD2 | CD2 | GM-CSF |
| 331 | iNKT | Mono | CD2 | CD2 | CCL2 |
| 332 | iNKT | Mono | CD2 | CD2 | MCP-2 |
| 333 | iNKT | Mono | CD2 | CD2 | G-CSF |
| 334 | iNKT | Mono | CD2 | CD2 | M-CSF |
| 335 | iNKT | Mono | CD2 | CD2 | Il-4 |
| 336 | iNKT | Mono | CD2 | CD2 | IFNγ |
| 337 | iNKT | Mono | CD5 | — | GM-CSF |
| 338 | iNKT | Mono | CD5 | — | CCL2 |
| 339 | iNKT | Mono | CD5 | — | MCP-2 |
| 340 | iNKT | Mono | CD5 | — | G-CSF |
| 341 | iNKT | Mono | CD5 | — | M-CSF |
| 342 | iNKT | Mono | CD5 | — | Il-4 |
| 343 | iNKT | Mono | CD5 | — | IFNγ |
| 344 | iNKT | Mono | CD5 | CD5 | GM-CSF |
| 345 | iNKT | Mono | CD5 | CD5 | CCL2 |
| 346 | iNKT | Mono | CD5 | CD5 | MCP-2 |
| 347 | iNKT | Mono | CD5 | CD5 | G-CSF |
| 348 | iNKT | Mono | CD5 | CD5 | M-CSF |
| 349 | iNKT | Mono | CD5 | CD5 | Il-4 |
| 350 | iNKT | Mono | CD5 | CD5 | IFNγ |
| 351 | iNKT | Tandem | CD7xCD2 | CD7 & CD2 | GM-CSF |
| 352 | iNKT | Tandem | CD7xCD2 | CD7 & CD2 | CCL2 |
| 353 | iNKT | Tandem | CD7xCD2 | CD7 & CD2 | MCP-2 |
| 354 | iNKT | Tandem | CD7xCD2 | CD7 & CD2 | G-CSF |
| 355 | iNKT | Tandem | CD7xCD2 | CD7 & CD2 | M-CSF |
| 356 | iNKT | Tandem | CD7xCD2 | CD7 & CD2 | Il-4 |
| 357 | iNKT | Tandem | CD7xCD2 | CD7 & CD2 | IFNγ |
| 358 | iNKT | Tandem | CD3εxCD2 | CD3 & CD2 | GM-CSF |
| 359 | iNKT | Tandem | CD3εxCD2 | CD3 & CD2 | CCL2 |
| 360 | iNKT | Tandem | CD3εxCD2 | CD3 & CD2 | MCP-2 |
| 361 | iNKT | Tandem | CD3εxCD2 | CD3 & CD2 | G-CSF |
| 362 | iNKT | Tandem | CD3εxCD2 | CD3 & CD2 | M-CSF |
| 363 | iNKT | Tandem | CD3εxCD2 | CD3 & CD2 | Il-4 |
| 364 | iNKT | Tandem | CD3εxCD2 | CD3 & CD2 | IFNγ |
| 365 | iNKT | Tandem | CD19xCD20 | — | GM-CSF |
| 366 | iNKT | Tandem | CD19xCD20 | — | CCL2 |
| 367 | iNKT | Tandem | CD19xCD20 | — | MCP-2 |
| 368 | iNKT | Tandem | CD19xCD20 | — | G-CSF |
| 369 | iNKT | Tandem | CD19xCD20 | — | M-CSF |
| 370 | iNKT | Tandem | CD19xCD20 | — | Il-4 |
| 371 | iNKT | Tandem | CD19xCD20 | — | IFNγ |
| 372 | iNKT | Dual | CD7xCD2 | CD7 & CD2 | GM-CSF |
| 373 | iNKT | Dual | CD7xCD2 | CD7 & CD2 | CCL2 |
| 374 | iNKT | Dual | CD7xCD2 | CD7 & CD2 | MCP-2 |
| 375 | iNKT | Dual | CD7xCD2 | CD7 & CD2 | G-CSF |
| 376 | iNKT | Dual | CD7xCD2 | CD7 & CD2 | M-CSF |
| 377 | iNKT | Dual | CD7xCD2 | CD7 & CD2 | Il-4 |
| 378 | iNKT | Dual | CD7xCD2 | CD7 & CD2 | IFNγ |
| 379 | iNKT | Dual | CD3εxCD2 | CD3 & CD2 | GM-CSF |
| 380 | iNKT | Dual | CD3εxCD2 | CD3 & CD2 | CCL2 |
| 381 | iNKT | Dual | CD3εxCD2 | CD3 & CD2 | MCP-2 |
| 382 | iNKT | Dual | CD3εxCD2 | CD3 & CD2 | G-CSF |
| 383 | iNKT | Dual | CD3εxCD2 | CD3 & CD2 | M-CSF |
| 384 | iNKT | Dual | CD3εxCD2 | CD3 & CD2 | Il-4 |
| 385 | iNKT | Dual | CD3εxCD2 | CD3 & CD2 | IFNγ |
| 386 | iNKT | Dual | CD19xCD20 | — | GM-CSF |
| 387 | iNKT | Dual | CD19xCD20 | — | CCL2 |
| 388 | iNKT | Dual | CD19xCD20 | — | MCP-2 |
| 389 | iNKT | Dual | CD19xCD20 | — | G-CSF |

TABLE 13-continued

| Example | Cell | Mono, Dual, or Tandem | CAR Target(s) | Antigen Deletion(s) | Gene Deleted/ Suppressed |
|---|---|---|---|---|---|
| 390 | iNKT | Dual | CD19xCD20 | — | M-CSF |
| 391 | iNKT | Dual | CD19xCD20 | — | Il-4 |
| 392 | iNKT | Dual | CD19xCD20 | — | IFNγ |

Example 8—Biological Assays

The following assays, or variations thereon, may be used to assess efficacy of the cytokine-deficient chimeric antigen receptor (CAR)-bearing immune effector cells disclosed herein.

T-ALL. Testing efficacy of cells in a xenogeneic model of T-ALL: $1 \times 10^5$ Click Beetle Red luciferase (CBR) labeled CCRF-CEM T-ALL (99% CD7+ by FACS) cells will be injected I.V. into NSG recipients prior to infusion of $2 \times 10^6$ to $1 \times 10^7$ CAR7-bearing immune effector cells or non-targeting CAR19-bearing immune effector cells control cells i.v. on day +4. In contrast to mice receiving CART19-bearing immune effector cells or mice injected with tumor only, mice receiving CAR7-bearing immune effector cells will demonstrate significantly prolonged survival and reduced tumor burden as determined by bioluminescent imaging.

Multiple Myeloma. Testing efficacy of INKT-CAR-CSI in a xenogeneic model of multiple myeloma: $5 \times 10^5$ Click Beetle Red luciferase (CBR) labeled MM.1S (99% CS1+ by FACS) cells will be injected I.V. into NSG recipients prior to infusion of $2 \times 10^6$ to $1 \times 10^7$ iNKT-CAR-CS1 or non-targeting iNKT-CAR19 control cells i.v. on day +4, or +14 or +28. In contrast to mice receiving iNKT-CAR19 or mice injected with tumor only, mice receiving iNKT-CAR-CS1 will demonstrate significantly prolonged survival and reduced tumor burden as determined by bioluminescent imaging.

In Vivo Models of Cytokine Release Syndrome and Neurotoxicity.

An in vivo mouse model of CRS is disclosed in Giavridis et al., "CAR T cell-induced cytokine release syndrome is mediated by macrophages and abated by IL-1 blockade," Nat Med 2018 May 28. For example, in order to initiate CRS as a model system, tumor cells are injected intraperitoneally into immune deficient mice and allowed to develop into a tumor. The mice are then given CAR-T cells targeting the cancerous cells and monitored for several days to induce the onset of CRS, after which mice are sacrificed and cells and tissue obtained for analysis. Mice may also be treated for CRS and monitored for success or failure of treatment (i.e., administering antibodies against cytokines produces as a result of administration of CAR-T cells).

Analyses appropriate for monitoring CRS in such a model may include monitoring of weight change in the mice after administration of CAR-T cells, percent survival of mice, serum levels of inflammatory factors, i.e., murine SAA3 (equivalent to human C-reactive protein), cytokine levels before and after administration of CAR-T cells, species of origin of pro-inflammatory cytokines (i.e., human versus murine cytokines; and/or percent survival of mice treated with CAR-T cells that received antibodies against specific cytokines.

Mice that eventually die from CRS symptoms or complications may be classified as having severe CRS, while mice that survive but suffer greater than 10% weight loss may be classified as having non-severe CRS. Using this model, it was discovered that monocytes and macrophages are the main source for IL-6 in CRS.

Another model useful for assessing both CRS and CAR-T associated neuropathy is disclosed in Norelli, "Monocyte-derived IL-1 and IL-6 are differentially required for cytokine-release syndrome and neurotoxicity due to CAR T cells," Nat Med 2018 May 28. In this model, human stem cells, such as hematopoietic stem and progenitor cells (HSPCs), are injected into humanized NSG mice, which are immunocompromised transgenic mice expressing human stem cell factor, GM-CSF, and IL-3 to support and enhance hematopoiesis from the injected human stem cells. The mice are given tumor cells to serve as targets for subsequently administered CAR-T cells, and then monitored for CRS symptoms. Following injection of CAR-T cells, these mice exhibit typical symptoms of CRS, including high fever and elevated levels of certain cytokines implicated in CRS, such as IL-1 and/or IL-6. Control of CRS in these mice may be accomplished by blocking the receptor for the cytokine using, for example, antibodies, depletion of cell types expressing the cytokine, or administration of an antagonist of the cytokine. As above, it was determined that monocytes are the main source of the pro-CRS cytokine IL-6, and depletion of monocytes eliminated CRS and protected the mice from death from CRS.

Other CRS animal models are known in the art and may also be used as deemed appropriate.

Methods for Inducing and Testing Cytokine Release Syndrome for Control Purposes

In one model, IL-7 may be directly injected into a mouse or other animal model to induce or initiate CRS for control purposes, as described herein. In yet another example, recombinant or transgenic IL-7 may be expressed in a cell to result in increased IL-7 signaling.

In a still further example, a constitutively signaling cytokine receptor, such as an IL-7 receptor, may be engineered into an immune effector cell such that the immune effector cell itself triggers IL-7 signaling, but is unresponsive to extracellular IL-7, and initiation of IL-7 signaling of surrounding lymphocytes is avoided. Additionally, co-expressing a constitutively signaling IL-7 receptor with a CAR recognizing a specific disease or tumor antigen results in increased T-cell proliferation, survival, and antitumor activity. A constitutively expressing IL-7 receptor is able to transmit IL-7 signaling without the need for IL-7 ligand or the common gamma $\gamma_c$ chain, a component of the native IL-7 receptor, along with IL-7Rα. This can be accomplished by engineering cysteine and/or proline into the transmembrane domain of the IL-7Rα chain, which results in homodimerization of IL-7Rα and subsequent phosphorylation of JAK1/JAK1, which then activates downstream signaling of IL-7.

An example of a method for making and testing a genome-edited CAR-T cell deficient at inducing CRS by insertion of selectable marker into gene edited locus is provided below.

Example 9—Insertion of CAR into T Cell Receptor Gene

A CAR or any protein of interest may be inserted into the gene for the T cell receptor. Macleod et al. ("Integration of a CD19 CAR into the TCR Alpha Chain Locus Streamlines Production of Allogeneic Gene-Edited CAR T Cells," Molec Therapy 25 (4): P949-961, 2017) reports the generation of allogeneic CAR T cells by targeting the insertion of a CAR transgene directly into the native TCR locus using an engineered homing endonuclease and an AAV donor template. Anti-CD19 CAR T cells produced in this manner do not express the endogenous cell-surface TCR, exhibit potent effector functions in vitro, and mediate clearance of CD19+ tumors in an in vivo mouse model. The resulting gene-edited CAR T cells exhibit potent anti-tumor activity in vitro and in vivo in preclinical models, suggesting that these cells have potential for safe and efficacious use as adoptive cellular therapy in unrelated patients with CD19+ hematological malignancies.

Example 10—Anti-Cytokine/Chemokine Antibodies to Reduce CRS

Introduction of immune effector cells to a patient or subject for treatment of cancer often results in CRS due to the production and secretion of cytokines and/or chemokines by the immune effector cells. One way to prevent CRS is to administer antibodies recognizing a specific CRS-inducing cytokine or chemokine to the patient or subject such that the amount of circulating cytokine/chemokine is reduced. For example, as reported by Sachdeva et al., (*J Biol Chem* 294 (14): 5430-5437, 2019), administration of anti-GMCSF antibodies reduced the GMCSF secretion thereby effectively reducing CRS. Therefore, administering antibodies recognizing a specific cytokine and/or chemokine can prevent or reduce the occurrence of CRS in a patient or subject.

Example 11—Insertion of CAR into GMCSF Gene

One exemplary way to prevent CRS is to insert a CAR into a gene for a cytokine or chemokine that is involved in initiation or prolonging of CRS. Disruption or ablation of a cytokine or chemokine gene in a CAR-T or other immune effector cell prevents the initiation of CRS by that particular cytokine or chemokine. One example of such a gene is GMCSF, although other genes involved in initiating or prolonging CRS may also be disrupted in this or a similar manner as described herein. Disruption of the GMCSF gene is described at least in Sachdeva et al. (*J Biol Chem* 294 (14): 5430-5437, 2019) and a description of making and testing a CAR-T cell inserted into the GM-CSF gene is provided below. Briefly, a TALEN or other gene-editing enzyme may be designed or engineered to target a cytokine or chemokine gene of choice in a CAR-T cell, and the expression of the gene monitored by methods known in the art. Significant reduction in the expression and secretion of the cytokine or chemokine gene by the CAR-T cell was reported, which implies that the occurrence of CRS would be reduced. Additionally, this approach was found to simultaneously maintain both the proliferation capability and the anti-tumor activity of the CAR-T cell, as assessed by transwell assays and serial killing assays.

In addition to the use of gene editing to delete a gene such as GM-CSF, antibodies to a cytokine or chemokine causing or contributing to CRS may also be used. For example, an antibody recognizing the GM-CSF protein may be administered to a patient or subject receiving CAR-T therapy. This practice is known in the art, particularly for reduction of CRS as a result of IL-6 signaling using the IL-6R antagonist tocilizumab, however other antibodies or antagonists recognizing cytokines or chemokines, or antagonists of their receptors, may be used as deemed appropriate by a clinician. Appropriate antibodies will bind to the circulating cytokine or chemokine, and antagonists will bind to the native receptors for the cytokine or chemokine, thus preventing downstream CRS-promoting activities in the subject. In some instances, both of these approaches may be employed in a subject, i.e., insertion of a CAR into the gene for a cytokine or chemokine to inactivate the gene, and also administering antibodies against the same cytokine or chemokine to the subject. This approach has been shown to be effective while conferring no negative effects on the activity of the CAR-T cells in vivo or in vitro (Sterner et al., "GM-CSF inhibition reduces cytokine release syndrome and neuroinflammation but enhances CAR-T cell function in xenografts," *Blood* 133:697-709, 2019).

Example 12—Method of Making and Testing Genome-Edited CAR-T Cells Deficient at Inducing CRS by Insertion of Selectable Marker into Gene Edited Loci Inject tumor in SCID-Beige mice (3e6 Raji containing Luciferase) if performing in vivo CRS experiment. This should be completed 3 weeks prior to infusion of CAR-T into mice.

The following steps may be taken to provide a genome-edited, CRS-resistant, CAR-T cell in which the CAR is expressed from the gene edited loci with a selectable marker disclosed herein. It is not possible to select and purify edited cells based on the deletion of genes that encode internal or secreted proteins, thus a selectable marker is required to enrich for this gene modification. This example describes the making of a CD19CARTΔGMCSFΔCD3ε cell, in which the deletion of GM-CSF mitigates risk of CRS and deletion of CD3ε prevents TCR signaling and graft vs host disease (GvHD). As those of skill in the art will recognize, certain of the steps may be conducted sequentially or out of the order listed below, though perhaps leading to different efficiency.

Step 1: T Cell Activation (Day 0)

Purify T cells from leukapheresis chamber using a Miltenyi human PanT isolation kit. Resuspend in media. Count cells. Determine number of human T cell activation CD3/CD28 beads required to obtain 3:1 bead: cell ratio. Wash beads 2× with T cell media. Dilute cells at 1.256 cells/mL in hXcyte media. Add human T cell activation CD3/CD28 beads. Aliquot 4 mL/well of 1.256 cell/mL solution into 6 well plate. Incubate cells at 37° C.

Step 2: CRISPR (Day 2)

The target gene is genetically deleted and the CAR inserted into the gene edited loci. The DNA double-stranded break can be repaired using homology directed repair using a donor template to repair the break and insert the desired sequence into the edited loci. Target deletion may be accomplished by electroporating with Cas9 mRNA and gRNA against the target(s). The donor template may be a DNA plasmid, or a double-stranded linear DNA, or a single stranded-stranded linear DNA containing homology to the DNA surrounding the double-stranded breaks electroplated with the Cas9/gRNA. In this example the homology arms align to either side of the double-stranded break induced by gRNA GM-CSF. Additionally, a viral vector such as AAV may be used as the source of the donor template. Other techniques, however, could be used to induce DNA double strand breaks. These include other genome editing techniques such as TALENs and mega-nucleases.

The sequences of the gRNAs for GM-CSF and CD38 are as follows:

hGMCSF gRNA:
(SEQ ID NO: 50)
5'_2'OMe(U(ps)A(ps)C(ps))UCAGGUUCAGGAGACGCGUUUUA

GAGCUAGAAAUAGCAAGUUAAAAUAAGGCUAGUCCGUUAUCAACUUGA

AAAAGUGGCACCGAGUCGGUGC2'OMe(U(ps)U(ps)U(ps)U_3'

CD3ε gRNA:
(SEQ ID NO: 47)
5'_2'OMe(A(ps)G(ps)G(ps))GCAUGUCAAUAUUACUGGUUUUA

GAGCUAGAAAUAGCAAGUUAAAAUAAGGCUAGUCCGUUAUCAACUUGA

AAAAGUGGCACCGAGUCGGUGC2'OMe(U(ps)U(ps)U(ps)U 3'

| Sample ID | gRNA#1 | gRNA#2 | Cas9 | Nucleofection Buffer P3 |
|---|---|---|---|---|
| UCART19 | 20 μg gGM-CSF | 20 μg gCD3ε | 15 μg Cas9 mRNA | 100 μl |

Nucleofection Using Nucleofector 4D:

Perform nucleofection protocol as described above (Example 6), using 20 μg of each gRNA (gGM-CSF and gCD38) to each tube of 15 μg cas9 mRNA.

Figure 3:
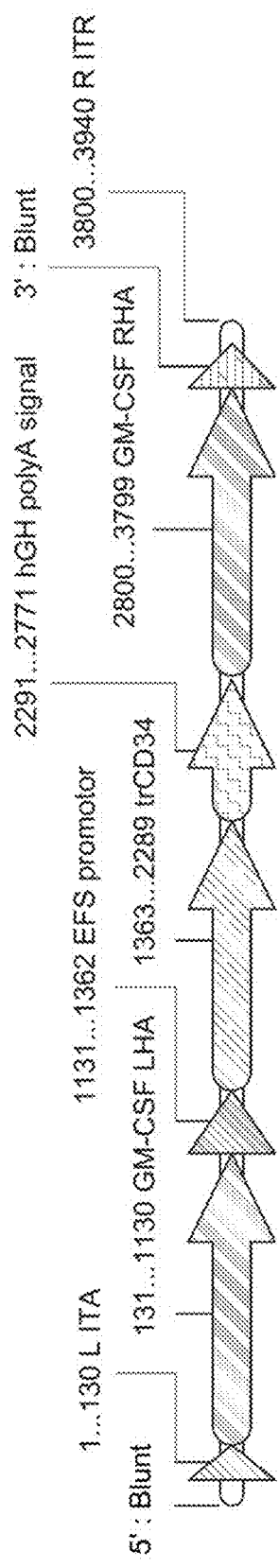
FIG. 3—Shows the AAV donor construct for insertion of CD34 into the GM-CSF locus.

Step 3: Transduction of T Cells with AAV Vector Containing HDR Repair Construct to Introduce CAR and a Selectable Marker into GM-CSF Loci Sequences for components of vectors described herein are provided in the sequence listing, such as including, but not limited to, SEQ ID NOs: 3048-3064. For example, recombinant AAV6 donor vector (FIG. 3, containing ITR-Right homology arm (SEQ ID NO: 51), EF1a promotor (SEQ ID NO:52), CAR19 p2a trCD34 (SEQ ID NO:53), Left homology arm (SEQ ID NO:54), ITR (SEQ ID NO:55), is added to the cell culture 2-4 hrs after electroporation with a MOI between $1 \times 10^4$ and $1 \times 10^6$.

Step 4: Assessment of CRISPR Activity and Td Efficiency (Day 10)

Take $5 \times 10^5$ cells from each sample and analyze by flow cytometry. Wash samples with RB. Add 3 μl of anti-CD34 PE antibody (This detects the insertion TrCD34 tag into GM-CSF loci). Add 5 μl of CD3 APC and 2 μl of anti-FAB BV421 (detects CAR transduction). Wash. Perform Flow cytometry. Cells should be CD38-negative, CD34-positive and FAB+. Harvest T cells (Day 11).

Purification of CAR-T cells. TCR-negative cells can be purified using TCRa/b negative selection to remove TCR positive cells. GM-CSF deleted cells can be enriched using a CD34-positive selection on the Miltenyi Automacs. This enriches the GM-SCF-cells and removes TCR+ cells.

Step 5: Assessment of CAR-T Activity In Vivo

Inject $3 \times 10^7$ CAR-T per mouse I.P. Assess serum cytokine levels. (Day 12, Day 13, Day 14) Measure serum cytokine levels using Luminex multiplex cytokine profiling assay to check for elevations in CRS related cytokines. Perform a 4 hr chromium release assay against targets cells (Raji) to assess in vitro activity (Day 11).

Example 13—Confirmation of GFP Expression with EGFP Integration into CD3e Locus of Jurkats Under Control of CD3e Promotor Direct insertion of GFP into the CD3e locus of a Jurkat cell line may be performed using the method details below.

Figure 4:
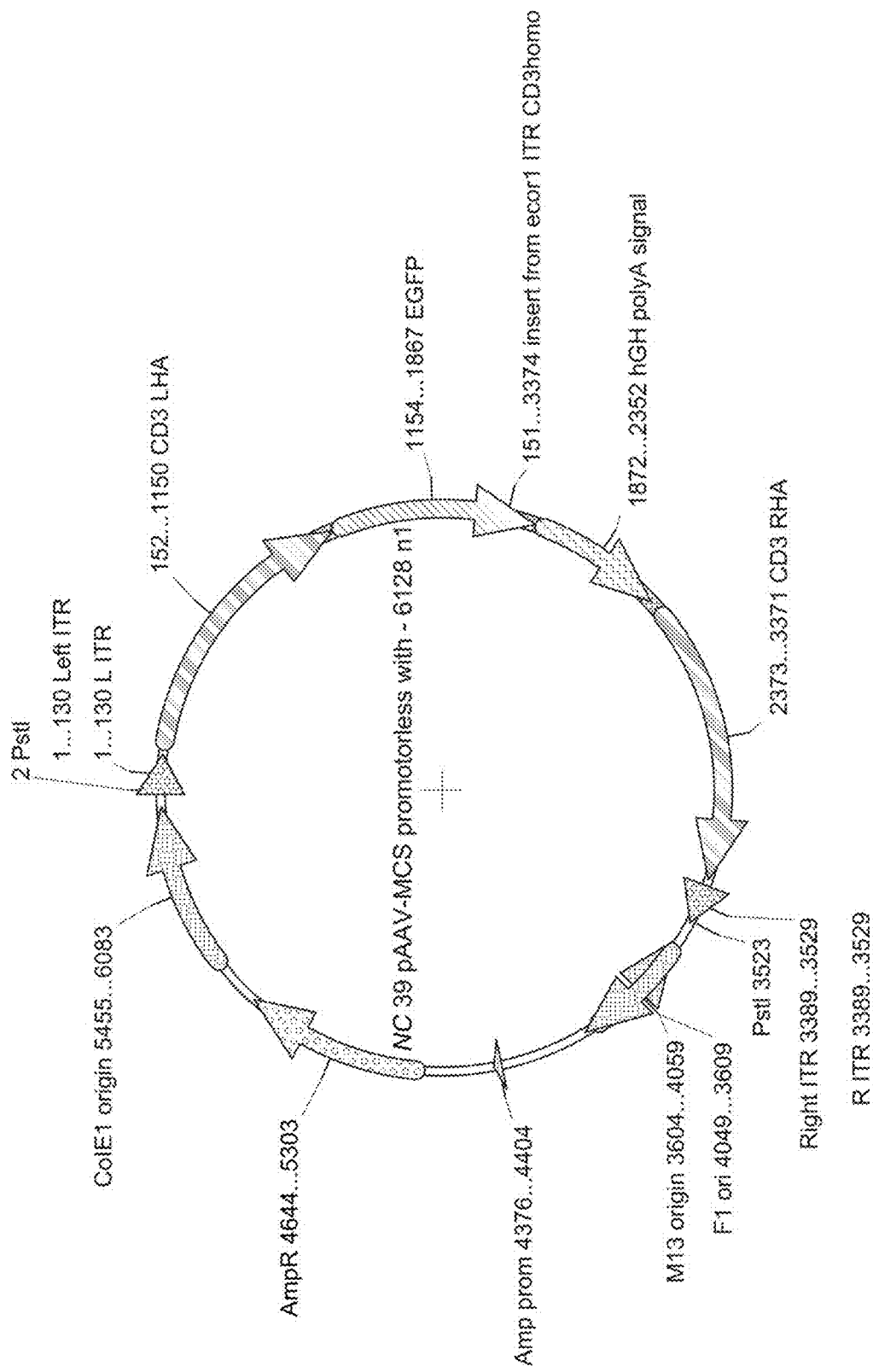
FIG. 4—Shows the WC40 plasmid vector for use in inserting GFP into the CD3ε locus.
Figures 5, 6:
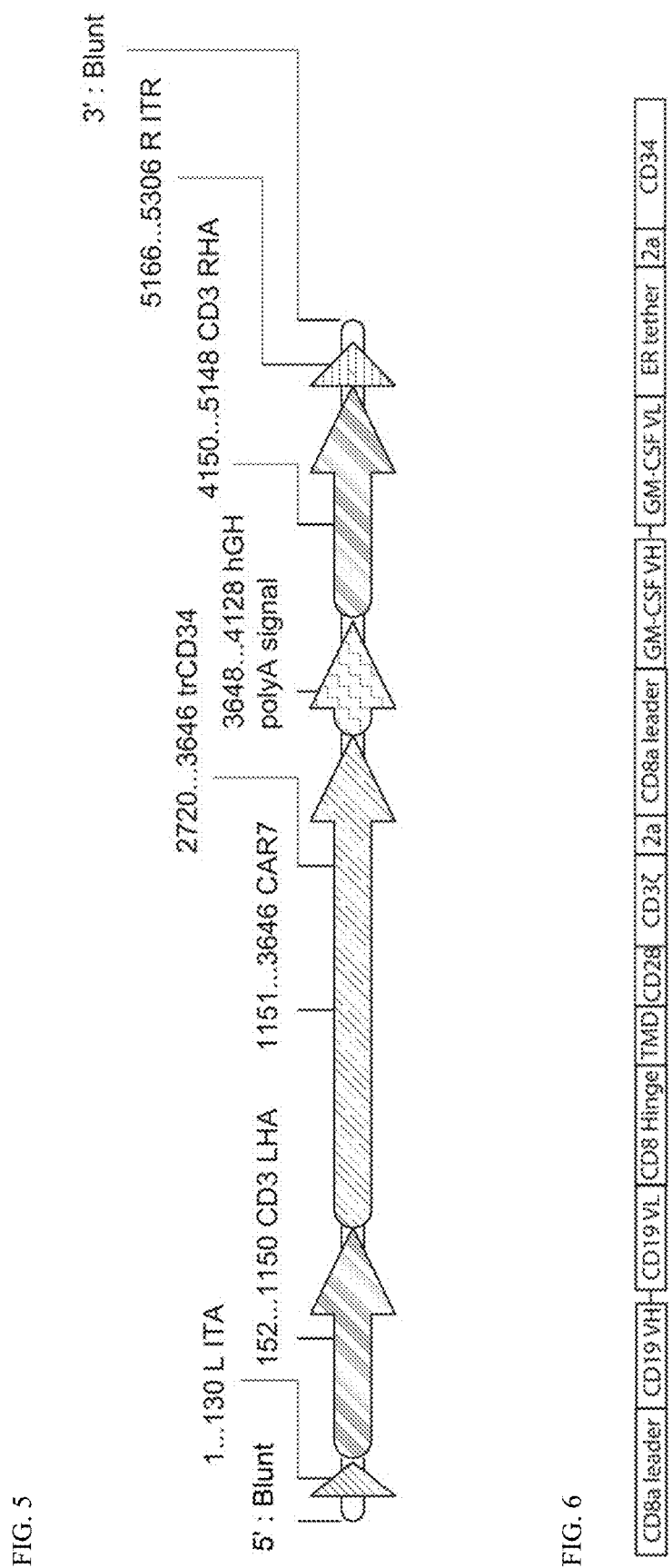
FIG. 5—Shows the AAV donor construct for insertion of GFP into the CD3ε locus.
FIG. 6—Shows a CAR19-GM-CSF PEBL-trCD34 construct.

Days prior: Digest plasmid with PST1 (FIG. 4). Two fragments (3.5 kb and 2.6 kb) are generated upon digestion. Purify using gel extraction kit and ethanol precipitate. Resuspend at 500 ng/μl. This generates donor template 'DNA' in table below Make and titre AAV. The sequence of the AAV is shown in FIG. 5 and provided in SEQ ID NOs:306. This generates donor template 'AAV' in the Table below.

Donor template 'plasmid' is shown in the table below.

Day 0:

Harvest jurkats and count. Spin cells down @100 g for 10 mins. Transfer cells to 1.5 m microcentrifuge tube and wash in PBS. Spin cells down @100×g for 10 mins. Resuspend in pre-warmed buffer SE. Add 100 μl to tube containing gRNA/Cas9. Transfer to nucleocuvette and zap using the Jurkat program on 4D. Transfer to pre-warmed media in 2 ml respective media in a 6-well plate. Return to incubator and expand for 4 days.

TABLE 14

| | Name | Nucleofector Solution | Cell line | Cell number | Cas9 mRNA | gRNA | Donor template |
|---|---|---|---|---|---|---|---|
| 1 | WT | — | Jurkat | 4 × 10⁶ | — | 20 μg CD3e | — |
| 2 | 3Δ | SE | Jurkat | 4 × 10⁶ | 15 μg | 20 μg CD3e | — |
| 3 | P-1ug | SE | Jurkat | 4 × 10⁶ | 15 μg | 20 μg CD3e | Plasmid 1ug |
| 4 | P-2ug | SE | Jurkat | 4 × 10⁶ | 15 μg | 20 μg CD3e | Plasmid 2ug |
| 5 | P-2ug | SE | Jurkat | 4 × 10⁶ | 15 μg | 20 μg CD3e | Plasmid 3ug |
| 6 | D-1ug | SE | Jurkat | 4 × 10⁶ | 15 μg | 20 μg CD3e | DNA 1ug |
| 7 | D-2ug | SE | Jurkat | 4 × 10⁶ | 15 μg | 20 μg CD3e | DNA 2ug |
| 8 | D-4ug | SE | Jurkat | 4 × 10⁶ | 15 μg | 20 μg CD3e | DNA 3ug |
| 9 | AAV Td | SE | Jurkat | 4 × 10⁶ | 15 μg | 20 μg CD3e | AAV 1e4 |
| 10 | AAV Td | SE | Jurkat | 4 × 10⁶ | 15 μg | 20 μg CD3e | AAV 1e5 |
| 11 | AAV Td | SE | Jurkat | 4 × 10⁶ | 15 μg | 20 μg CD3e | AAV 1e6 |

Day 4: FACS cells for GFP and CD3 APC. Assess editing efficiency by loss of CD3 and integration of the AAV-GFP donor by GFP fluorescence.

Example 14—Method of Making and Testing a Genome-Edited CAR-T Cells by Insertion of CAR into CD3e Loci The following steps may be taken to provide a genome-edited CAR-T cell in which the car is expressed from the gene edited loci (CAR-T) disclosed herein. This example describes the making of a CD7CART ΔCD7 ΔCD3ε cell. As those of skill in the art will recognize, certain of the steps may be conducted sequentially or out of the order listed below, though perhaps leading to different efficiency.
Step 1: T Cell Activation (Day 0)
Purify T cells from leukapheresis chamber using Miltenyi human PanT isolation kit. Resuspend in media. Count cells. Determine number of human T cell activation CD3/CD28 beads required to obtain 3:1 bead: cell ratio. Wash beads 2× with T cell media. Dilute cells at 1.256 cells/mL in hXcyte media. Add human T cell activation CD3/CD28 beads. Aliquot 4 mL/well of 1.256 cell/mL solution into 6 well plate. Incubate cells at 37° C.
Step 2: CRISPR (Day 2)
The target gene is genetically deleted and the CAR inserted into the gene edited loci. The DNA double-stranded break can be repaired using homology-directed repair using a donor template to repair the break and insert the desired sequence into the edited loci. Target deletion may be accomplished by electroporating with Cas9 mRNA and gRNA against the target(s). The donor template may be a DNA plasmid, or double-stranded linear DNA, or single-stranded linear DNA containing homology to the DNA surrounding the double-stranded breaks electroporated with the Cas9/gRNA. Additionally, a viral vector such as AAV may be used as the source of the donor template. Other techniques, however, could be used to induce DNA double-stranded breaks. These include other genome editing techniques, such as TALENs and mega-nucleases.

| Sample ID | gRNA#1 | gRNA#2 | Cas9 | Nucleofection Buffer P3 |
|---|---|---|---|---|
| UCART7 | 20 μg gCD7 | 20 μg gCD3ε | 15 μg Cas9 mRNA | 100 μl |

Nucleofection Using Nucleofector 4D:
Perform nucleofection protocol as described above (Example 6), using 20 μg of each gRNA (gCD7 and gCD38) to each tube of 15 μg Cas9.
Step 3: Transduction of T Cells with AAV Vector Containing HDR Repair Construct
Recombinant AAV6 (or other serotypes of AAV) donor vector is added to the cell culture 2-4 hrs after electroporation with an MOI between $1 \times 10^4$ and $1 \times 10^6$.
Step 4: Assessment of CRISPR Activity and Td Efficiency (Day 10)
Take $5 \times 10^5$ cells from each sample and analyze by flow cytometry. Wash samples with RB. Add 3 μl of anti-CD34 PE antibody (This detects the CAR, as the construct contains human truncated CD34). Add 5 μl of CD3 APC and 2 μl of CD7 BV421. Wash. Perform Flow cytometry. Cells should be CD38-negative, CD7-negative and CD34-positive. Harvest T cells (Day 11).
Purification of CAR-T cells. CD34+ (CAR+) and TCR-negative cells can be purified in a single step using a positive selection of CD34+ cells on a Miltenyi Automacs. This enriches the CAR+ cells and removes and TCR+ cells (as CAR insertion disrupts TCR signaling).
Step 5: Assessment of CAR-T Activity In Vivo
Inject tumor in NSG mice ($5 \times 10^5$ MOLT3 or HH: containing Luciferase) if performing in vivo imaging experiment (Day 7).
Image tumor burden in mouse using bioluminescent imaging. Inject $2 \times 10^6$ CD34+CAR-T per mouse I.V. via tail vein or perform a 4 hr chromium release assay against targets cell (MOLT3 or HH) (Day 11). Those of skill in the art will appreciate that some flexibility is possible in the specified time frames.

Example 15—Cytokine/Chemokine Gene Silencing Using shRNA

Similar to siRNAs, short hairpin RNA can be used to knock down or eliminate expression of a cytokine/chemokine/transcription factor gene in an immune effector cell.
Cherkassky et al. ("Human CAR T cells with cell-intrinsic PD-1 checkpoint blockade resist tumor-mediated inhibition," *J Clin Investig* 2016; 126:3130-3144) reported use of shRNA to knock down expression of immune checkpoint PD-1 in CD28 mesothelin-specific CAR-T cells, which showed enhanced proliferative function upon antigen stimulation, augmented cytotoxicity, and enhanced cytokine secretion. In addition, a CD19-specific CAR with a PD-1 shRNA lentiviral cassette has been tested for use in CD19-positive B-cell lymphoma. A list of useful shRNAs and their sequences is provided in Tables 15 and 16.

TABLE 15

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| A2M | CCGGAGGCGTCCCTATACCAAA TAACTCGAGTTATTTGGTATAG GGACGCCTTTTTTG | 1046 | chr12 | ENST00000318602.11 |
| A2M | CCGGAGACTGCATCAATCGTCA TAACTCGAGTTATGACGATTGA TGCAGTCTTTTTTG | 1047 | chr12 | ENST00000318602.11 |
| A2M | CCGGCCTCCAGACATCCTTGAA ATACTCGAGTATTTCAAGGATG TCTGGAGGTTTTTG | 1048 | chr12 | ENST00000318602.11 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| ACKR1 | CCGGATCCTGTGGGCCTGGTTTATTCTCGAGAATAAACCAGGCCCACAGGATTTTTTG | 1049 | chr1 | ENST00000368122.2 |
| ACKR1 | CCGGTGGCAGAAGCCCTGGCAATTTCTCGAGAAATTGCCAGGGCTTCTGCCATTTTTG | 1050 | chr1 | ENST00000368122.2 |
| ACKR1 | CCGGGGCGGATGGTTGAGATCTATCCTCGAGGATAGATCTCAACCATCCGCCTTTTTG | 1051 | chr1 | ENST00000368122.2 |
| ACKR2 | CCGGGAGCACTCTTTATACTATTAACTCGAGTTAATAGTATAAAGAGTGCTCTTTTTG | 1052 | chr3 | ENST00000422265.5 |
| ACKR2 | CCGGGTGGAACTGCCACGCAGATTTCTCGAGAAATCTGCGTGGCAGTTCCACTTTTTG | 1053 | chr3 | ENST00000422265.5 |
| ACKR2 | CCGGCATTGGGTCTTCGGGAGTTTCCTCGAGGAAACTCCCGAAGACCCAATGTTTTTG | 1054 | chr3 | ENST00000422265.5 |
| ACKR3 | CCGGCACTATTGGTGTACCTTATAACTCGAGTTATAAGGTACACCAATAGTGTTTTTG | 1055 | chr2 | ENST00000272928.3 |
| ACKR3 | CCGGGGCATAGTGCTGACATATATTCTCGAGAATATATGTCAGCACTATGCCTTTTTG | 1056 | chr2 | ENST00000272928.3 |
| ACKR3 | CCGGGCCGTTCCCTTCTCCATTATCCTCGAGGATAATGGAGAAGGGAACGGCTTTTTG | 1057 | chr2 | ENST00000272928.3 |
| ACVR1 | CCGGTGATAATTCCCTCGACAAATTCTCGAGAATTTGTCGAGGGAATTATCATTTTTG | 1058 | chr2 | ENST00000263640.7 |
| ACVR1 | CCGGGCAGAACGTATTTAGCCATTACTCGAGTAATGGCTAAATACGTTCTGCTTTTTG | 1059 | chr2 | ENST00000263640.7 |
| ACVR1 | CCGGCTGGTCTGTCTTTGGATAATACTCGAGTATTATCCAAAGACAGACCAGTTTTTG | 1060 | chr2 | ENST00000263640.7 |
| ACVR2B | CCGGATGTCACGAGGCCTCTCATACCTCGAGGTATGAGAGGCCTCGTGACATTTTTG | 1061 | chr3 | ENST00000352511.4 |
| ACVR2B | CCGGCCCAGCTCATGAATGACTTTGCTCGAGCAAAGTCATTCATGAGCTGGGTTTTG | 1062 | chr3 | ENST00000352511.4 |
| ACVR2B | CCGGCTTTGGCTTGGCTGTTCGATTCTCGAGAATCGAACAGCCAAGCCAAAGTTTTTG | 1063 | chr3 | ENST00000352511.4 |
| ACVRL1 | CCGGCCGGGAGACTGAGATCTATAACTCGAGTTATAGATCTCAGTCTCCCGGTTTTTG | 1064 | chr12 | ENST00000388922.8 |
| ACVRL1 | CCGGCAGGAGCACCTGATTCCTTTCCTCGAGGAAAGGAATCAGGTGCTCCTGTTTTTG | 1065 | chr12 | ENST00000388922.8 |
| ACVRL1 | CCGGCGTGGAGATCTTCGGTACACACTCGAGTGTGTACCGAAGATCTCCACGTTTTTG | 1066 | chr12 | ENST00000388922.8 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
| --- | --- | --- | --- | --- |
| ADIPOQ | CCGGGTTGGAGGCCTTTAGATATTACTCGAGTAATATCTAAAGGCCTCCAACTTTTTG | 1067 | chr3 | ENST00000320741.6 |
| ADIPOQ | CCGGATGCTCATATCAATCCTATAACTCGAGTTATAGGATTGATATGAGCATTTTTG | 1068 | chr3 | ENST00000320741.6 |
| ADIPOQ | CCGGACGGTTAGGAAGTTGATTATTCTCGAGAATAATCAACTTCCTAACCGTTTTTG | 1069 | chr3 | ENST00000320741.6 |
| AGER | CCGGCACACTGCAGTCGGAGCTAATCTCGAGATTAGCTCCGACTGCAGTGTGTTTTTG | 1070 | chr6 | ENST00000375076.8 |
| AGER | CCGGGAAGCCAGAAATTGTAGATTCCTCGAGGAATCTACAATTTCTGGCTTCTTTTTG | 1071 | chr6 | ENST00000375076.8 |
| AGER | CCGGTGCTGATCCTCCCTGAGATAGCTCGAGCTATCTCAGGGAGGATCAGCATTTTTG | 1072 | chr6 | ENST00000375076.8 |
| AGRN | CCGGGAGTTCTGTGTGGAAGATAAACTCGAGTTTATCTTCCACACAGAACTCTTTTTG | 1073 | chr1 | ENST00000379370.6 |
| AGRN | CCGGGCGCACGTATGACAGTGATTGCTCGAGCAATCACTGTCATACGTGCGCTTTTTG | 1074 | chr1 | ENST00000379370.6 |
| AGRN | CCGGACGACGGAGTCACCTACGAAACTCGAGTTTCGTAGGTGACTCCGTCGTTTTTG | 1075 | chr1 | ENST00000379370.6 |
| AHR | CCGGCGGCATAGAGACCGACTTAATCTCGAGATTAAGTCGGTCTCTATGCCGTTTTTG | 1076 | chr7 | ENST00000242057.8 |
| AHR | CCGGGCGGCATAGAGACCGACTTAACTCGAGTTAAGTCGGTCTCTATGCCGCTTTTTG | 1077 | chr7 | ENST00000242057.8 |
| AHR | CCGGATCCACAGTCAGCCATAATAACTCGAGTTATTATGGCTGACTGTGGATTTTTG | 1078 | chr7 | ENST00000242057.8 |
| AHR | CCGGACTGCTTAAAGTTGGTATTAACTCGAGTTAATACCAACTTTAAGCAGTTTTTG | 1079 | chr7 | ENST00000242057.8 |
| AIMP1 | CCGGCAGCCTGATCTTCACACTAATCTCGAGATTAGTGTGAAGATCAGGCTGTTTTTG | 1080 | chr4 | ENST00000358008.7 |
| AIMP1 | CCGGAGAAGTAGATGTCGGAGAAATCTCGAGATTTCTCCGACATCTACTTCTTTTTTG | 1081 | chr4 | ENST00000358008.7 |
| AIMP1 | CCGGGCCAGAGTAACCCTGACTAATCTCGAGATTAGTCAGGGTTACTCTGGCTTTTTG | 1082 | chr4 | ENST00000358008.7 |
| AREG | CCGGCCTCTTTCCAGTGGATCATAACTCGAGTTATGATCCACTGGAAAGAGGTTTTG | 1083 | chr4 | ENST00000395748.7 |
| AREG | CCGGTACTCGGCTCAGGCCATTATGCTCGAGCATAATGGCCTGAGCCGAGTATTTTG | 1084 | chr4 | ENST00000395748.7 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| AREG | CCGGATTCACGGAGAATGCAAA TATCTCGAGATATTTGCATTCTC CGTGAATTTTTG | 1085 | chr4 | ENST00000395748.7 |
| BCL6 | CCGGTGTGCCACAGCAATATCT ATTCTCGAGAATAGATATTGCT GTGGCACATTTTTG | 1086 | chr3 | ENST00000406870.6 |
| BCL6 | CCGGACTGCGTTAAAGGCTCGA TTTCTCGAGAAATCGAGCCTTT AACGCAGTTTTTG | 1087 | chr3 | ENST00000406870.6 |
| BCL6 | CCGGCCGGCTCAATAACATCGT TAACTCGAGTTAACGATGTTAT TGAGCCGGTTTTTG | 1088 | chr3 | ENST00000406870.6 |
| BCL6 | CCGGACAAGCCAGCCGGCTCAA TAACTCGAGTTATTGAGCCGGC TGGCTTGTTTTTG | 1089 | chr3 | ENST00000406870.6 |
| BMP1 | CCGGACTGACGAGGACAGCTAT ATTCTCGAGAATATAGCTGTCC TCGTCAGTTTTTG | 1090 | chr8 | ENST00000306385.9 |
| BMP1 | CCGGGCTCGTAAGTCCTCCATC AAACTCGAGTTTGATGGAGGAC TTACGAGCTTTTTG | 1091 | chr8 | ENST00000306385.9 |
| BMP1 | CCGGACAGCTGTGCCTACGACT ATCCTCGAGGATAGTCGTAGGC ACAGCTGTTTTTG | 1092 | chr8 | ENST00000306385.9 |
| BMP10 | CCGGAGCAAGACGGTGTCGACT TTACTCGAGTAAAGTCGACACC GTCTTGCTTTTTG | 1093 | chr2 | ENST00000295379.1 |
| BMP10 | CCGGGCGTCGTCACCTACAAGT TTACTCGAGTAAACTTGTAGGT GACGACGCTTTTTG | 1094 | chr2 | ENST00000295379.1 |
| BMP10 | CCGGCATGGCTGAACTTAGGCT ATACTCGAGTATAGCCTAAGTT CAGCCATGTTTTTG | 1095 | chr2 | ENST00000295379.1 |
| BMP15 | CCGGTACTACGCGATGGTCTCA ATTCTCGAGAATTGAGACCATC GCGTAGTATTTTTG | 1096 | chrX | ENST00000252677.3 |
| BMP15 | CCGGGCCTTCTTGTTACTCTATT TCCTCGAGGAAATAGAGTAACA AGAAGGCTTTTTG | 1097 | chrX | ENST00000252677.3 |
| BMP15 | CCGGATGGAACACAGGGCCCA AATGCTCGAGCATTTGGGCCCT GTGTTCCATTTTTG | 1098 | chrX | ENST00000252677.3 |
| BMP2 | CCGGGATCATCTGAACTCCACT AATCTCGAGATTAGTGGAGTTC AGATGATCTTTTTG | 1099 | chr20 | ENST00000378827.4 |
| BMP2 | CCGGCCGGAGATTCTTCTTTAA TTTCTCGAGAAATTAAAGAAGA ATCTCCGGTTTTTG | 1100 | chr20 | ENST00000378827.4 |
| BMP2 | CCGGCAAGATGCTTTAGGAAAC AATCTCGAGATTGTTTCCTAAA GCATCTTGTTTTTG | 1101 | chr20 | ENST00000378827.4 |
| BMP3 | CCGGCTTACAGGGACACCGGAA TTTCTCGAGAAATTCCGGTGTC CCTGTAAGTTTTTG | 1102 | chr4 | ENST00000282701.2 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| BMP3 | CCGGGGCCAAATCTCATCGAGATATCTCGAGATATCTCGATGAGATTTGGCCTTTTTG | 1103 | chr4 | ENST00000282701.2 |
| BMP3 | CCGGGTGGATTGAACCTCGGAATTGCTCGAGCAATTCCGAGGTTCAATCCACTTTTTG | 1104 | chr4 | ENST00000282701.2 |
| BMP4 | CCGGCCCTGGTCAATTCTGTCAATTCTCGAGAATTGACAGAATTGACCAGGGTTTTTG | 1105 | chr14 | ENST00000245451.8 |
| BMP4 | CCGGTCCTTGAGGATAGACAGATATCTCGAGATATCTGTCTATCCTCAAGGATTTTTG | 1106 | chr14 | ENST00000245451.8 |
| BMP4 | CCGGAGGGCCAGCATGTCAGGATTACTCGAGTAATCCTGACATGCTGGCCCTTTTTG | 1107 | chr14 | ENST00000245451.8 |
| BMP5 | CCGGTGGACGCAGTATCAACGTAAACTCGAGTTTACGTTGATACTGCGTCCATTTTTG | 1108 | chr6 | ENST00000370830.3 |
| BMP5 | CCGGCCAGAAGGATACGCTGCATTTCTCGAGAAATGCAGCGTATCCTTCTGGTTTTTG | 1109 | chr6 | ENST00000370830.3 |
| BMP5 | CCGGATGCCACCAACCACGCTATAGCTCGAGCTATAGCGTGGTTGGTGGCATTTTTG | 1110 | chr6 | ENST00000370830.3 |
| BMP6 | CCGGATACAGGAATATGGTTGTAAGCTCGAGCTTACAACCATATTCCTGTATTTTTG | 1111 | chr6 | ENST00000283147.6 |
| BMP6 | CCGGCGCCGACAACAGAGTCGTAATCTCGAGATTACGACTCTGTTGTCGGCGTTTTTG | 1112 | chr6 | ENST00000283147.6 |
| BMP6 | CCGGCTGTCTATCAAAGGTAGATTTCTCGAGAAATCTACCTTTGATAGACAGTTTTTG | 1113 | chr6 | ENST00000283147.6 |
| BMP7 | CCGGACGTTCCGGATCAGCGTTTATCTCGAGATAAACGCTGATCCGGAACGTTTTTG | 1114 | chr20 | ENST00000395863.7 |
| BMP7 | CCGGACTCGTTTCCAGAGGTAATTACTCGAGTAATTACCTCTGGAAACGAGTTTTTG | 1115 | chr20 | ENST00000395863.7 |
| BMP7 | CCGGACCATCGAGAGTTCCGGTTTGCTCGAGCAAACCGGAACTCTCGATGGTTTTTG | 1116 | chr20 | ENST00000395863.7 |
| BMP8A | CCGGAGGGTGCAGTTAGCATATTAGCTCGAGCTAATATGCTAACTGCACCCTTTTTG | 1117 | chr1 | ENST00000331593.5 |
| BMP8A | CCGGAGCACAGAAGTCCTATCTTAGCTCGAGCTAAGATAGGACTTCTGTGCTTTTTG | 1118 | chr1 | ENST00000331593.5 |
| BMP8A | CCGGAGGTACAACACTGGCCATTTCCTCGAGGAAATGGCAGTGTTGTACCTTTTTG | 1119 | chr1 | ENST00000331593.5 |
| BMP8B | CCGGCCAAGGCTACTCGGCCTATTACTCGAGTAATAGGCCGAGTAGCCTTGGTTTTTG | 1120 | chr1 | ENST00000372827.7 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| BMP8B | CCGGGACCCTCACAACCACGTACATCTCGAGATGTACGTGGTTGTGAGGGTCTTTTTG | 1121 | chr1 | ENST00000372827.7 |
| BMP8B | CCGGCGTTAACATGGTGGAGCGAGACTCGAGTCTCGCTCCACCATGTTAACGTTTTTG | 1122 | chr1 | ENST00000372827.7 |
| BMPR2 | CCGGGAACGGCTATGTGCGTTTAAACTCGAGTTTAAACGCACATAGCCGTTCTTTTTG | 1123 | chr2 | ENST00000374580.8 |
| BMPR2 | CCGGGCCTATGGAGTGAAATTATTTCTCGAGAAATAATTTCACTCCATAGGCTTTTTG | 1124 | chr2 | ENST00000374580.8 |
| BMPR2 | CCGGATTACCACGAGGAGATCATTACTCGAGTAATGATCTCCTCGTGGTAATTTTTG | 1125 | chr2 | ENST00000374580.8 |
| C10orf99 | CCGGCATCATGTGAGGCTCTGTAAACTCGAGTTTACAGAGCCTCACATGATGTTTTTG | 1126 | chr10 | ENST00000372126.3 |
| C10orf99 | CCGGCCCAACTCAACAAACCTGAAACTCGAGTTTCAGGTTTGTTGAGTTGGGTTTTTG | 1127 | chr10 | ENST00000372126.3 |
| C10orf99 | CCGGGCCATCAACTTTCAGAGCTATCTCGAGATAGCTCTGAAAGTTGATGGCTTTTTG | 1128 | chr10 | ENST00000372126.3 |
| C1QTNF4 | CCGGACACCGAGTTCGTCAACATTGCTCGAGCAATGTTGACGAACTCGGTGTTTTTG | 1129 | chr11 | ENST00000302514.3 |
| C1QTNF4 | CCGGGCGTAAGACGCTGTCGGTTAACTCGAGTTAACCGACAGCGTCTTACGCTTTTTG | 1130 | chr11 | ENST00000302514.3 |
| C1QTNF4 | CCGGCGAGGTGCAGGCCATGATTTACTCGAGTAAATCATGGCCTGCACCTCGTTTTTG | 1131 | chr11 | ENST00000302514.3 |
| C5 | CCGGACGATGGAGCCTGCGTTAATACTCGAGTATTAACGCAGGCTCCATCGTTTTTG | 1132 | chr9 | ENST00000223642.2 |
| C5 | CCGGTCCCGACTTCTGGTCTATTACCTCGAGGTAATAGACCAGAAGTCGGGATTTTTG | 1133 | chr9 | ENST00000223642.2 |
| C5 | CCGGGCCCGAGAGAACAGCTTATATCTCGAGATATAAGCTGTTCTCTCGGGCTTTTTG | 1134 | chr9 | ENST00000223642.2 |
| CCL1 | CCGGGCAATCCTGTGTTACAGAAATCTCGAGATTTCTGTAACACAGGATTGCTTTTTG | 1135 | chr17 | ENST00000225842.3 |
| CCL1 | CCGGCTGCTCCAATGAGGGCTTAATCTCGAGATTAAGCCCTCATTGGAGCAGTTTTTG | 1136 | chr17 | ENST00000225842.3 |
| CCL1 | CCGGCCTGAGGGCAATCCTGTGTTACTCGAGTAACACAGGATTGCCCTCAGGTTTTTG | 1137 | chr17 | ENST00000225842.3 |
| CCL11 | CCGGCCAACTCCAAAGCCATAAATACTCGAGTATTTATGGCTTTGGAGTTGGTTTTTG | 1138 | chr17 | ENST00000305869.3 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| CCL11 | CCGGCATTCTGAGGTAACCTCATTACTCGAGTAATGAGGTTACCTCAGAATGTTTTTG | 1139 | chr17 | ENST00000305869.3 |
| CCL11 | CCGGTCCTCCATGAATATCAGTTATCTCGAGATAACTGATATTCATGGAGGATTTTTG | 1140 | chr17 | ENST00000305869.3 |
| CCL13 | CCGGTGGAATACTTCTACCATAATTCTCGAGAATTATGGTAGAAGTATTCCATTTTTG | 1141 | chr17 | ENST00000225844.6 |
| CCL13 | CCGGTCAAGCTGGAGTACGTGAAATCTCGAGATTTCACGTACTCCAGCTTGATTTTTG | 1142 | chr17 | ENST00000225844.6 |
| CCL13 | CCGGACTCAACGTCCCATCTACTTGCTCGAGCAAGTAGATGGGACGTTGAGTTTTTG | 1143 | chr17 | ENST00000225844.6 |
| CCL14 | CCGGCCTAGGGACCAAGACTGAATCCTCGAGGATTCAGTCTTGGTCCCTAGGTTTTTG | 1144 | chr17 | ENST00000618404.4 |
| CCL14 | CCGGCAGCGGATTATGGATTACTATCTCGAGATAGTAATCCATAATCCGCTGTTTTTG | 1145 | chr17 | ENST00000618404.4 |
| CCL14 | CCGGCAAGCCCGGAATTGTCTTCATCTCGAGATGAAGACAATTCCGGGCTTGTTTTTG | 1146 | chr17 | ENST00000618404.4 |
| CCL15 | CCGGGCTGAAGCCCTACTCAATATACTCGAGTATATTGAGTAGGGCTTCAGCTTTTTG | 1147 | chr17 | ENST00000617897.1 |
| CCL15 | CCGGACAGAGTTAATGATGTCAAAGCTCGAGCTTTGACATCATTAACTCTGTTTTTG | 1148 | chr17 | ENST00000617897.1 |
| CCL15 | CCGGATCCCGTGTTCACTCATGAAACTCGAGTTTCATGAGTGAACACGGGATTTTTG | 1149 | chr17 | ENST00000617897.1 |
| CCL16 | CCGGAGGAGAAGTATTTCGAATATTCTCGAGAATATTCGAAATACTTCTCCTTTTTG | 1150 | chr17 | ENST00000611905.1 |
| CCL16 | CCGGAGGAACTTGTCCACGGTTAAACTCGAGTTTAACCGTGGACAAGTTCCTTTTTG | 1151 | chr17 | ENST00000611905.1 |
| CCL16 | CCGGCTGCCTGAAGTATTATGAGAACTCGAGTTCTCATAATACTTCAGGCAGTTTTTG | 1152 | chr17 | ENST00000611905.1 |
| CCL17 | CCGGGAGAGTGAAGAATGCAGTTAACTCGAGTTAACTGCATTCTTCACTCTCTTTTTG | 1153 | chr16 | ENST00000219244.8 |
| CCL17 | CCGGGAGTACTTCAAGGGAGCCATTCTCGAGAATGGCTCCCTTGAAGTACTCTTTTTG | 1154 | chr16 | ENST00000219244.8 |
| CCL17 | CCGGGCAAAGCCTTGAGAGGTCTTGCTCGAGCAAGACCTCTCAAGGCTTTGCTTTTTG | 1155 | chr16 | ENST00000219244.8 |
| CCL18 | CCGGTCTATTGTTGAGCTGCATTATCTCGAGATAATGCAGCTCAACAATAGATTTTTG | 1156 | chr17 | ENST00000616054.1 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| CCL18 | CCGGCCTTCAACTCTTCGTACAT TCCTCGAGGAATGTACGAAGAG TTGAAGGTTTTTG | 1157 | chr17 | ENST00000616054.1 |
| CCL18 | CCGGGTCTATACCTCCTGGCAG ATTCTCGAGAATCTGCCAGGAG GTATAGACTTTTTG | 1158 | chr17 | ENST00000616054.1 |
| CCL19 | CCGGGAGTCAAGCATTGTGAAT TATCTCGAGATAATTCACAATG CTTGACTCTTTTTG | 1159 | chr9 | ENST00000311925.6 |
| CCL19 | CCGGGCCGCAGCAGTTAACCTA TGACTCGAGTCATAGGTTAACT GCTGCGGCTTTTTG | 1160 | chr9 | ENST00000311925.6 |
| CCL19 | CCGGCCAACTCTGAGTGGCACC AATCTCGAGATTGGTGCCACTC AGAGTTGGTTTTTG | 1161 | chr9 | ENST00000311925.6 |
| CCL2 | CCGGCCCAGTCACCTGCTGTTA TAACTCGAGTTATAACAGCAGG TGACTGGGTTTTTG | 1162 | chr17 | ENST00000225831.4 |
| CCL2 | CCGGCCCAGTCACCTGCTGTTA TAACTCGAGTTATAACAGCAGG TGACTGGGTTTTTG | 1163 | chr17 | ENST00000225831.4 |
| CCL2 | CCGGGCTCGCGAGCTATAGAAG AATCTCGAGATTCTTCTATAGCT CGCGAGCTTTTTG | 1164 | chr17 | ENST00000225831.4 |
| CCL20 | CCGGAGTTGTCTGTGTGCGCAA ATCCTCGAGGATTTGCGCACAC AGACAACTTTTTG | 1165 | chr2 | ENST00000358813.4 |
| CCL20 | CCGGGACCGTATTCTTCATCCT AAACTCGAGTTTAGGATGAAGA ATACGGTCTTTTTG | 1166 | chr2 | ENST00000358813.4 |
| CCL20 | CCGGAGGGTTTAGTGCTTATCT AATCTCGAGATTAGATAAGCAC TAAACCCTTTTTG | 1167 | chr2 | ENST00000358813.4 |
| CCL21 | CCGGCACTCTTTCTCCTGCTTTA ACCTCGAGGTTAAAGCAGGAGA AAGAGTGTTTTTG | 1168 | chr9 | ENST00000259607.6 |
| CCL21 | CCGGGAGCTATGTGCAGACCCA AAGCTCGAGCTTTGGGTCTGCA CATAGCTCTTTTTG | 1169 | chr9 | ENST00000259607.6 |
| CCL21 | CCGGCCATCCCAGCTATCCTGT TCTCTCGAGAGAACAGGATAGC TGGGATGGTTTTTG | 1170 | chr9 | ENST00000259607.6 |
| CCL22 | CCGGCCCTACCTCCCTGCCATT ATACTCGAGTATAATGGCAGGG AGGTAGGGTTTTTG | 1171 | chr16 | ENST00000219235.4 |
| CCL22 | CCGGGCGTGGTGAAACACTTCT ACTCTCGAGAGTAGAAGTGTTT CACCACGCTTTTTG | 1172 | chr16 | ENST00000219235.4 |
| CCL22 | CCGGATGTTGCTGACACCCAGA AAGCTCGAGCTTTCTGGGTGTC AGCAACATTTTTG | 1173 | chr16 | ENST00000219235.4 |
| CCL23 | CCGGCACTCCTGGAGAGTTACT TTGCTCGAGCAAAGTAACTCTC CAGGAGTGTTTTTG | 1174 | chr17 | ENST00000615050.1 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| CCL23 | CCGGCCTTTCTCATGCTGCAGG ATTCTCGAGAATCCTGCAGCAT GAGAAAGGTTTTTG | 1175 | chr17 | ENST00000615050.1 |
| CCL23 | CCGGGAAGCTGGACACACGGAT CAACTCGAGTTGATCCGTGTGT CCAGCTTCTTTTTG | 1176 | chr17 | ENST00000615050.1 |
| CCL24 | CCGGAGTGATCTTCACCACCAA GAACTCGAGTTCTTGGTGGTGA AGATCACTTTTTG | 1177 | chr7 | ENST00000222902.6 |
| CCL24 | CCGGGTTCTTTGTTTCCAAGAG AATCTCGAGATTCTCTTGGAAA CAAAGAACTTTTTG | 1178 | chr7 | ENST00000222902.6 |
| CCL24 | CCGGCCTGCTGCATGTTCTTTGT TTCTCGAGAAACAAAGAACATG CAGCAGGTTTTTG | 1179 | chr7 | ENST00000222902.6 |
| CCL25 | CCGGGCCGGATCTTTCTCCGAT AAACTCGAGTTTATCGGAGAAA GATCCGGCTTTTTG | 1180 | chr19 | ENST00000390669.7 |
| CCL25 | CCGGGCTCCTGGATGCTCGAAA TAACTCGAGTTATTTCGAGCAT CCAGGAGCTTTTTG | 1181 | chr19 | ENST00000390669.7 |
| CCL25 | CCGGCCCTCCTGATATCAGCTA ATTCTCGAGAATTAGCTGATAT CAGGAGGGTTTTTG | 1182 | chr19 | ENST00000390669.7 |
| CCL26 | CCGGCACACGTGGGAGTGACAT ATCCTCGAGGATATGTCACTCC CACGTGTGTTTTTG | 1183 | chr7 | ENST00000005180.8 |
| CCL26 | CCGGTCCGAAACAATTGTGACT CAGCTCGAGCTGAGTCACAATT GTTTCGGATTTTTG | 1184 | chr7 | ENST00000005180.8 |
| CCL26 | CCGGGCTGTGATATTCACTACC AAACTCGAGTTTGGTAGTGAAT ATCACAGCTTTTTG | 1185 | chr7 | ENST00000005180.8 |
| CCL27 | CCGGTTCGTGCTTCACCTGGCTC AACTCGAGTTGAGCCAGGTGAA GCACGAATTTTTG | 1186 | chr9 | ENST00000259631.4 |
| CCL27 | CCGGCCGAAAGCCACTCTCAGA CAACTCGAGTTGTCTGAGAGTG GCTTTCGGTTTTTG | 1187 | chr9 | ENST00000259631.4 |
| CCL27 | CCGGCAAGCTACTGAGGAAGGT CATCTCGAGATGACCTTCCTCA GTAGCTTGTTTTTG | 1188 | chr9 | ENST00000259631.4 |
| CCL28 | CCGGCGGAGGTTTCACATCATA TTTCTCGAGAAATATGATGTGA AACCTCCGTTTTTG | 1189 | chr5 | ENST00000361115.4 |
| CCL28 | CCGGCACGAAACATACGGCCAT AAACTCGAGTTTATGGCCGTAT GTTTCGTGTTTTTG | 1190 | chr5 | ENST00000361115.4 |
| CCL28 | CCGGTTAGAGAGTCTACAGATA AATCTCGAGATTTATCTGTAGA CTCTCTAATTTTTG | 1191 | chr5 | ENST00000361115.4 |
| CCL3 | CCGGCCGGCAGATTCCACAGAA TTTCTCGAGAAATTCTGTGGAA TCTGCCGGTTTTTG | 1192 | chr17 | ENST00000613922.1 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| CCL3 | CCGGTTCGATTTCACAGTGTGTTTGCTCGAGCAAACACACTGTGAAATCGAATTTTTG | 1193 | chr17 | ENST00000613922.1 |
| CCL3 | CCGGCAACCAGTTCTCTGCATCACTCTCGAGAGTGATGCAGAGAACTGGTTGTTTTTG | 1194 | chr17 | ENST00000613922.1 |
| CCL4 | CCGGATGTGCCGTGTTATTGTATTACTCGAGTAATACAATAACACGGCACATTTTTG | 1195 | chr17 | ENST00000615863.1 |
| CCL4 | CCGGTCCTGTCCCTTCTCTTAATTTCTCGAGAAATTAAGAGAAGGGACAGGATTTTTG | 1196 | chr17 | ENST00000615863.1 |
| CCL4 | CCGGCTGTGCTGATCCCAGTGAATCCTCGAGGATTCACTGGGATCAGCACAGTTTTTG | 1197 | chr17 | ENST00000615863.1 |
| CCL5 | CCGGTGAACCTGAACTTACACAAATCTCGAGATTTGTGTAAGTTCAGGTTCATTTTTG | 1198 | chr17 | ENST00000603197.5 |
| CCL5 | CCGGCCTGCTGCTTTGCCTACATTGCTCGAGCAATGTAGGCAAAGCAGCAGGTTTTTG | 1199 | chr17 | ENST00000603197.5 |
| CCL5 | CCGGCTACCACACAGCAGCAGTTACCTCGAGGTAACTGCTGCTGTGTGGTAGTTTTTG | 1200 | chr17 | ENST00000603197.5 |
| CCL7 | CCGGCATAAAGCCTTGGATGTATATCTCGAGATATACATCCAAGGCTTTATGTTTTTG | 1201 | chr17 | ENST00000378569.2 |
| CCL7 | CCGGGCTGCTACAGATTATCAATACTCGAGTATTGATAATCTGTAGCAGCTTTTTG | 1202 | chr17 | ENST00000378569.2 |
| CCL7 | CCGGTCTAAGGAATATGAGCTTTATCTCGAGATAAAGCTCATATTCCTTAGATTTTTG | 1203 | chr17 | ENST00000378569.2 |
| CCL8 | CCGGGCTGCTTTAACGTGATCAATACTCGAGTATTGATCACGTTAAAGCAGCTTTTTG | 1204 | chr17 | ENST00000394620.1 |
| CCL8 | CCGGCAGGTGCAGTGTGACATTATTCTCGAGAATAATGTCACACTGCACCTGTTTTTG | 1205 | chr17 | ENST00000394620.1 |
| CCL8 | CCGGTTGTACTGCTGTTGTTGAAATCTCGAGATTTCAACAACAGCAGTACAATTTTTG | 1206 | chr17 | ENST00000394620.1 |
| CCR1 | CCGGATTCTGCTAAGACGACCAAATCTCGAGATTTGGTCGTCTTAGCAGAATTTTTG | 1207 | chr3 | ENST00000296140.3 |
| CCR1 | CCGGATCTGCTACACAGGGATTATACTCGAGTATAATCCCTGTGTAGCAGATTTTTG | 1208 | chr3 | ENST00000296140.3 |
| CCR1 | CCGGCCTCTGTACTCCTTGGTATTTCTCGAGAAATACCAAGGAGTACAGAGGTTTTTG | 1209 | chr3 | ENST00000296140.3 |
| CCR2 | CCGGACGGTGCTCCCTGTCATAAATCTCGAGATTTATGACAGGGAGCACCGTTTTTG | 1210 | chr3 | ENST00000445132.2 |

TABLE 15-continued

5' to 3' (Forward) shRNA sequences for Silencing of Cytokine/Chemokine
Genes to Reduce the Incidence of CRS

| Target Gene Symbol | shRNA Forward Oligo Sequence | SEQ ID NO: | Location | Gene ID No. |
| --- | --- | --- | --- | --- |
| CCR2 | CCGGCTTCTGGACTCCCTATAATATCTCGAGATATTATAGGGAGTCCAGAAGTTTTTG | 1211 | chr3 | ENST00000445132.2 |
| CCR2 | CCGGGCTGTATCACATCGGTTATTTCTCGAGAAATAACCGATGTGATACAGCTTTTTG | 1212 | chr3 | ENST00000445132.2 |
| CCR3 | CCGGATACAGGAGGCTCCGAATTATCTCGAGATAATTCGGAGCCTCCTGTATTTTTG | 1213 | chr3 | ENST00000357422.2 |
| CCR3 | CCGGCCCAGAGGATACAGTATATAGCTCGAGCTATATACTGTATCCTCTGGGTTTTTG | 1214 | chr3 | ENST00000357422.2 |
| CCR3 | CCGGTAGCAGCTCTTCCTGAATTTACTCGAGTAAATTCAGGAAGAGCTGCTATTTTTG | 1215 | chr3 | ENST00000357422.2 |
| CCR5 | CCGGACTCTTGACAGGGCTCTATTTCTCGAGAAATAGAGCCCTGTCAAGAGTTTTTG | 1216 | chr3 | ENST00000292303.4 |
| CCR5 | CCGGCGAGCGAGCAAGCTCAGTTTACTCGAGTAAACTGAGCTTGCTCGCTCGTTTTTG | 1217 | chr3 | ENST00000292303.4 |
| CCR5 | CCGGTCCATACAGTCAGTATCAATTCTCGAGAATTGATACTGACTGTATGGATTTTTG | 1218 | chr3 | ENST00000292303.4 |
| CCR6 | CCGGGGTCTATGACAGACGTCTATCCTCGAGGATAGACGTCGTCATAGACCTTTTTG | 1219 | chr6 | ENST00000341935.9 |
| CCR6 | CCGGCGACTCCAGTGAAGATTATTTCTCGAGAAATAATCTTCACTGGAGTCGTTTTTG | 1220 | chr6 | ENST00000341935.9 |
| CCR6 | CCGGTCGACTCCAGTGAAGATTATCTCGAGAATAATCTTCACTGGAGTCGATTTTTG | 1221 | chr6 | ENST00000341935.9 |
| CCR7 | CCGGGATGAGGTCACGGACGATTACCTCGAGGTAATCGTCCGTGACCTCATCTTTTTG | 1222 | chr17 | ENST00000246657.2 |
| CCR7 | CCGGGCTGGTCGTGTTGACCTATATCTCGAGATATAGGTCAACACGACCAGCTTTTTG | 1223 | chr17 | ENST00000246657.2 |
| CCR7 | CCGGCGTGTTGACCTATATCTATTTCTCGAGAAATAGATATAGGTCAACACGTTTTTG | 1224 | chr17 | ENST00000246657.2 |
| CD109 | CCGGGCCGATCCTTACATAGATATTCTCGAGAATATCTATGTAAGGATCGGCTTTTTG | 1225 | chr6 | ENST00000287097.5 |
| CD109 | CCGGCCCGGAGGAAATGTGACTATTCTCGAGAATAGTCACATTTCCTCCGGGTTTTTG | 1226 | chr6 | ENST00000287097.5 |
| CD109 | CCGGCCGCTTATCATTTGAGACCAACTCGAGTTGGTCTCAAATGATAAGCGGTTTTTG | 1227 | chr6 | ENST00000287097.5 |
| CD27 | CCGGCTTACCTTATGTCAGTGAGATCTCGAGATCTCACTGACATAAGGTAAGTTTTTG | 1228 | chr12 | ENST00000266557.3 |

TABLE 15-continued

5' to 3' (Forward) shRNA sequences for Silencing of Cytokine/Chemokine
Genes to Reduce the Incidence of CRS

| Target Gene Symbol | shRNA Forward Oligo Sequence | SEQ ID NO: | Location | Gene ID No. |
|---|---|---|---|---|
| CD27 | CCGGGCACTGTAACTCTGGTCTTCTCTCGAGAGAAGACCAGAGTTACAGTGCTTTTTG | 1229 | chr12 | ENST00000266557.3 |
| CD27 | CCGGCCACCCACTTACCTTATGTCACTCGAGTGACATAAGGTAAGTGGGTGGTTTTTG | 1230 | chr12 | ENST00000266557.3 |
| CD27 | CCGGGCCAGATGTGTGAGCCAGGAACTCGAGTTCCTGGCTCACACATCTGGCTTTTTG | 1231 | chr12 | ENST00000266557.3 |
| CD28 | CCGGCCTCCAGAATTTGTATGTTAACTCGAGTTAACATACAAATTCTGGAGGTTTTTG | 1232 | ch2 | ENST00000458610.6 |
| CD28 | CCGGCAACCTTAGCTGCAAGTATTCCTCGAGGAATACTTGCAGCTAAGGTTGTTTTTG | 1233 | ch2 | ENST00000458610.6 |
| CD28 | CCGGTGGAGTCCTGGCTTGCTATAGCTCGAGCTATAGCAAGCCAGGACTCCATTTTTG | 1234 | ch2 | ENST00000458610.6 |
| CD28 | CCGGCCTCCTCCTTACCTAGACAATCTCGAGATTGTCTAGGTAAGGAGGAGGTTTTTG | 1235 | ch2 | ENST00000458610.6 |
| CD36 | CCGGAGAACCTATTGATGGATTAAACTCGAGTTTAATCCATCAATAGGTTCTTTTTG | 1236 | chr7 | ENST00000309881.11 |
| CD36 | CCGGGCCATAATCGACACATATAAACTCGAGTTTATATGTGTCGATTATGGCTTTTTG | 1237 | chr7 | ENST00000309881.11 |
| CD36 | CCGGACGGCTGCAGGTCAACCTATTCTCGAGAATAGGTTGACCTGCAGCCGTTTTTG | 1238 | chr7 | ENST00000309881.11 |
| CD4 | CCGGCCTGATCATCAAGAATCTTAACTCGAGTTAAGATTCTTGATGATCAGGTTTTTG | 1239 | chr12 | ENST00000011653.8 |
| CD4 | CCGGAGAGCGGATGTCTCAGATCAACTCGAGTTGATCTGAGACATCCGCTCTTTTTG | 1240 | chr12 | ENST00000011653.8 |
| CD4 | CCGGCCACTCGCCTTTACAGTTGAACTCGAGTTCAACTGTAAAGGCGAGTGGTTTTTG | 1241 | chr12 | ENST00000011653.8 |
| CD40LG | CCGGGGGAAACAGCTGACCGTTAAACTCGAGTTTAACGGTCAGCTGTTTCCTTTTTG | 1242 | chrX | ENST00000370629.6 |
| CD40LG | CCGGTTCGAGTCAAGCTCCATTTATCTCGAGATAAATGGAGCTTGACTCGAATTTTTG | 1243 | chrX | ENST00000370629.6 |
| CD40LG | CCGGTGACGCTGGGAGTCTTCATAACTCGAGTTATGAAGACTCCCAGCGTCATTTTTG | 1244 | chrX | ENST00000370629.6 |
| CD70 | CCGGCCATCGTGATGGCATCTACATCTCGAGATGTAGATGCCATCACGATGGTTTTTG | 1245 | chr19 | ENST00000245903.3 |
| CD70 | CCGGCAGCTACGTATCCATCGTGATCTCGAGATCACGATGGATACGTAGCTGTTTTTG | 1246 | chr19 | ENST00000245903.3 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| CD70 | CCGGCCAACCTCACTGGGACAC TTTCTCGAGAAAGTGTCCCAGT GAGGTTGGTTTTTG | 1247 | chr19 | ENST00000245903.3 |
| CD74 | CCGGCAAGTCGGAACAGCAGAT AACCTCGAGGTTATCTGCTGTT CCGACTTGTTTTTG | 1248 | chr5 | ENST00000009530.11 |
| CD74 | CCGGGAGAACCTGAGACACCTT AAGCTCGAGCTTAAGGTGTCTC AGGTTCTCTTTTTG | 1249 | chr5 | ENST00000009530.11 |
| CD74 | CCGGCACACAGCTACAGCTTT CTTCTCGAGAAGAAAGCTGTAG CTGTGTGGTTTTTG | 1250 | chr5 | ENST00000009530.11 |
| CD8A | CCGGGCTGGACTTCGCCTGTGA TATCTCGAGATATCACAGGCGA AGTCCAGCTTTTTG | 1251 | ch2 | ENST00000409511.6 |
| CD8A | CCGGGTGTATTCATTCTCATGAT TACTCGAGTAATCATGAGAATG AATACACTTTTTG | 1252 | ch2 | ENST00000409511.6 |
| CD8A | CCGGCCAGAGACAGCTTGATCA AGCTCGAGCTTTGATCAAGCT GTCTCTGGTTTTTG | 1253 | ch2 | ENST00000409511.6 |
| CD8A | CCGGCCTTCTCCTGTCACTGGTT ATCTCGAGATAACCAGTGACAG GAGAAGGTTTTTG | 1254 | ch2 | ENST00000409511.6 |
| CER1 | CCGGGAGAAGATGCTGTCCAGA TTTCTCGAGAAATCTGGACAGC ATCTTCTCTTTTTG | 1255 | chr9 | ENST00000380911.3 |
| CER1 | CCGGCCAGCCGATAGATGGAAT GAACTCGAGTTCATTCCATCTA TCGGCTGGTTTTTG | 1256 | chr9 | ENST00000380911.3 |
| CER1 | CCGGCAAGAAATTCTGGCACCA CTTCTCGAGAAGTGGTGCCAGA ATTTCTTGTTTTTG | 1257 | chr9 | ENST00000380911.3 |
| CHRD | CCGGACGTCCTGCAAAGTGTCC TTTCTCGAGAAAGGACACTTTG CAGGACGTTTTTG | 1258 | chr3 | ENST00000204604.5 |
| CHRD | CCGGACTGATCCAGAGCTGGAG AAACTCGAGTTTCTCCAGCTCT GGATCAGTTTTTG | 1259 | chr3 | ENST00000204604.5 |
| CHRD | CCGGCGGCTGCTGAAGGGATTC TATCTCGAGATAGAATCCCTTC AGCAGCCGTTTTTG | 1260 | chr3 | ENST00000204604.5 |
| CKLF | CCGGCCTTTGCTTGTGTTTGCAC TTCTCGAGAAGTGCAAACACAA GCAAAGGTTTTTG | 1261 | chr16 | ENST00000264001.8 |
| CKLF | CCGGCCCTGAACCATATATTGT TATCTCGAGATAACAATATATG GTTCAGGGTTTTTG | 1262 | chr16 | ENST00000264001.8 |
| CKLF | CCGGTGGATTTGAAGTCACCGT TATCTCGAGATAACGGTGACTT CAAATCCATTTTTG | 1263 | chr16 | ENST00000264001.8 |
| CLCF1 | CCGGGAAACAAACATGGTGGC AATTCTCGAGAATTGCCACCAT GTTTGTTTCTTTTTG | 1264 | chr11 | ENST00000312438.7 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| CLCF1 | CCGGCCACAGGATTTCCTGAAAGTTCTCGAGAACTTTCAGGAAATCCTGTGGTTTTTG | 1265 | chr11 | ENST00000312438.7 |
| CLCF1 | CCGGCATGGTGGCAATTCTACACAACTCGAGTTGTGTAGAATTGCCACCATGTTTTTG | 1266 | chr11 | ENST00000312438.7 |
| CMTM1 | CCGGCACCACTTGCTGACCTATTTACTCGAGTAAATAGGTCAGCAAGTGGTGTTTTTG | 1267 | chr16 | ENST00000379500.6 |
| CMTM1 | CCGGGACCTATTTACATTGGCCCTTCTCGAGAAGGGCCAATGTAAATAGGTCTTTTTG | 1268 | chr16 | ENST00000379500.6 |
| CMTM1 | CCGGGCTGTGTTCCTTTCAGTAGTTCTCGAGAACTACTGAAAGGAACACAGCTTTTTG | 1269 | chr16 | ENST00000379500.6 |
| CMTM2 | CCGGGTAAGGAGCCATCGGACAAACCTCGAGGTTTGTCCGATGGCTCCTTACTTTTTG | 1270 | chr16 | ENST00000268595.2 |
| CMTM2 | CCGGCTTACTTGCTGTGATCCTTATCTCGAGATAAGGATCACAGCAAGTAAGTTTTTG | 1271 | chr16 | ENST00000268595.2 |
| CMTM2 | CCGGCATAAGGAGCCATCGGACAAACTCGAGTTTGTCCGATGGCTCCTTATGTTTTTG | 1272 | chr16 | ENST00000268595.2 |
| CMTM3 | CCGGCATCGTGTTTGCAACTGATTTCTCGAGAAATCAGTTGCAAACACGATGTTTTTG | 1273 | chr16 | ENST00000361909.8 |
| CMTM3 | CCGGGCTTCTTAACAGATGGCATTTCTCGAGAAATGCCATCTGTTAAGAAGCTTTTTG | 1274 | chr16 | ENST00000361909.8 |
| CMTM3 | CCGGGCTTCTTAACAGATGGCATTTCTCGAGAAATGCCATCTGTTAAGAAGCTTTTTG | 1275 | chr16 | ENST00000361909.8 |
| CMTM4 | CCGGCAACTGGAATCTGACAGATTTCTCGAGAAATCTGTCAGATTCCAGTTGTTTTTG | 1276 | chr16 | ENST00000394106.6 |
| CMTM4 | CCGGGACTGGCGTCTTGCTGATTATCTCGAGATAATCAGCAAGACGCCAGTCTTTTTG | 1277 | chr16 | ENST00000394106.6 |
| CMTM4 | CCGGGCAGAAATTGCTGCCGTGATACTCGAGTATCACGGCAGCAATTTCTGCTTTTTG | 1278 | chr16 | ENST00000394106.6 |
| CMTM5 | CCGGCAAGATCTACCGGACTGAGATCTCGAGATCTCAGTCCGGTAGATCTTGTTTTTG | 1279 | chr14 | ENST00000359320.7 |
| CMTM5 | CCGGCCTGACCCTCATCATCTTCATCTCGAGATGAAGATGATGAGGGTCAGGTTTTTG | 1280 | chr14 | ENST00000359320.7 |
| CMTM5 | CCGGCTTCCTCTATGCCACCCAGTACTCGAGTACTGGGTGGCATAGAGGAAGTTTTTG | 1281 | chr14 | ENST00000359320.7 |
| CMTM6 | CCGGGCCCTCACTGAGCCACTTAATCTCGAGATTAAGTGGCTCAGTGAGGGCTTTTTG | 1282 | chr3 | ENST00000205636.3 |

TABLE 15-continued

5' to 3' (Forward) shRNA sequences for Silencing of Cytokine/Chemokine
Genes to Reduce the Incidence of CRS

| Target Gene Symbol | shRNA Forward Oligo Sequence | SEQ ID NO: | Location | Gene ID No. |
|---|---|---|---|---|
| CMTM6 | CCGGCCCAAGACAGTGAAAGTAATTCTCGAGAATTACTTTCACTGTCTTGGGTTTTTG | 1283 | chr3 | ENST00000205636.3 |
| CMTM6 | CCGGCCCAAGACAGTGAAAGTAATTCTCGAGAATTACTTTCACTGTCTTGGGTTTTTG | 1284 | chr3 | ENST00000205636.3 |
| CMTM7 | CCGGCTGCTGAAAGTGGCGCAAATGCTCGAGCATTTGCGCCACTTTCAGCAGTTTTTG | 1285 | chr3 | ENST00000334983.9 |
| CMTM7 | CCGGCAAAGCCCTGTCCTAATTTATCTCGAGATAAATTAGGACAGGGCTTTGTTTTTG | 1286 | chr3 | ENST00000334983.9 |
| CMTM7 | CCGGCCTGTCGATCTTTGGTTTCATCTCGAGATGAAACCAAAGATCGACAGGTTTTTG | 1287 | chr3 | ENST00000334983.9 |
| CMTM8 | CCGGTGCTGGTATGGACGCTTATTGCTCGAGCAATAAGCGTCCATACCAGCATTTTTG | 1288 | chr3 | ENST00000307526.3 |
| CMTM8 | CCGGGCAAAGTGTTGTAGCTTATAACTCGAGTTATAAGCTACAACACTTTGCTTTTTG | 1289 | chr3 | ENST00000307526.3 |
| CMTM8 | CCGGATATTCCCAGAGAATTGTATTCTCGAGAATACAATTCTCTGGGAATATTTTTG | 1290 | chr3 | ENST00000307526.3 |
| CNTF | CCGGGTAACCTCTACAGGCATTTAACTCGAGTTAAATGCCTGTAGAGGTTACTTTTTG | 1291 | chr11 | ENST00000361987.5 |
| CNTF | CCGGGTTGAAGGACTACAGGTATTTCTCGAGAAATACCTGTAGTCCTTCAACTTTTTG | 1292 | chr11 | ENST00000361987.5 |
| CNTF | CCGGGGTGACTTCCATCAAGCTATACTCGAGTATAGCTTGATGGAAGTCACCTTTTTG | 1293 | chr11 | ENST00000361987.5 |
| CNTFR | CCGGCATTCTCTTCAGACACAATTTCTCGAGAAATTGTGTCTGAAGAGAATGTTTTTG | 1294 | chr9 | ENST00000351266.8 |
| CNTFR | CCGGGCATTCTCTTCAGACACAATTCTCGAGAATTGTGTCTGAAGAGAATGCTTTTTG | 1295 | chr9 | ENST00000351266.8 |
| CNTFR | CCGGGCCGGGAAGGAGTACATTATCCTCGAGGATAATGTACTCCTTCCCGGCTTTTTG | 1296 | chr9 | ENST00000351266.8 |
| COPS5 | CCGGCTAAGGATCACCATTACTTTACTCGAGTAAAGTAATGGTGATCCTTAGTTTTTG | 1297 | chr8 | ENST00000357849.8 |
| COPS5 | CCGGCCAGACTATTCCACTTAATAACTCGAGTTATTAAGTGGAATAGTCTGGTTTTTG | 1298 | chr8 | ENST00000357849.8 |
| COPS5 | CCGGCAGTCTCTGAGAAGTACTTTACTCGAGTAAAGTACTTCTCAGAGACTGTTTTTG | 1299 | chr8 | ENST00000357849.8 |
| CRLF1 | CCGGCGATGTACTCACGCTGGATATCTCGAGATATCCAGCGTGAGTACATCGTTTTTG | 1300 | chr19 | ENST00000392386.7 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| CRLF1 | CCGGCGATGTACTCACGCTGGATATCTCGAGATATCCAGCGTGAGTACATCGTTTTTG | 1301 | chr19 | ENST00000392386.7 |
| CRLF1 | CCGGCCCAGAGAAACCCGTCAACATCTCGAGATGTTGACGGGTTTCTCTGGGTTTTTG | 1302 | chr19 | ENST00000392386.7 |
| CSF1 | CCGGTCTCCTGGTACAAGACATAATCTCGAGATTATGTCTTGTACCAGGAGATTTTTG | 1303 | chr1 | ENST00000329608.10 |
| CSF1 | CCGGGTCGGCCTGATTTCCCGTAAACTCGAGTTTACGGGAAATCAGGCCGACTTTTTG | 1304 | chr1 | ENST00000329608.10 |
| CSF1 | CCGGTTGACAAGGACTGGAATATTTCTCGAGAAATATTCCAGTCCTTGTCAATTTTTG | 1305 | chr1 | ENST00000329608.10 |
| CSF1R | CCGGGTGAACAGCAAGTTCTATAAACTCGAGTTTATAGAACTTGCTGTTCACTTTTTG | 1306 | chr5 | ENST00000286301.7 |
| CSF1R | CCGGACAGGAGAGAGCGGGACTATACTCGAGTATAGTCCCGCTCTCTCCTGTTTTTTG | 1307 | chr5 | ENST00000286301.7 |
| CSF1R | CCGGGCTGCTATTGTACAAGTATAACTCGAGTTATACTTGTACAATAGCAGCTTTTTG | 1308 | chr5 | ENST00000286301.7 |
| CSF2 | CCGGGGAGCTGCTCTCTCATGAAACCTCGAGGTTTCATGAGAGAGCAGCTCCTTTTTG | 1309 | chr5 | ENST00000296871.3 |
| CSF2 | CCGGCCCAGATTATCACCTTTGAAACTCGAGTTTCAAAGGTGATAATCTGGGTTTTTG | 1310 | chr5 | ENST00000296871.3 |
| CSF2 | CCGGGAAGTCATCTCAGAAATGTTTCTCGAGAAACATTTCTGAGATGACTTCTTTTTG | 1311 | chr5 | ENST00000296871.3 |
| CSF3 | CCGGGTCTATTTAAGCCTCATATTTCTCGAGAAATATGAGGCTTAAATAGACTTTTTG | 1312 | chr17 | ENST00000225474.6 |
| CSF3 | CCGGGATAGGTAAATACCAAGTATTCTCGAGAATACTTGGTATTTACCTATCTTTTTG | 1313 | chr17 | ENST00000225474.6 |
| CSF3 | CCGGGCTTAGAGCAAGTGAGGAAGACTCGAGTCTTCCTCACTTGCTCTAAGCTTTTTG | 1314 | chr17 | ENST00000225474.6 |
| CSF3R | CCGGCAGCCAGGCCTGCACATAAATCTCGAGATTATGTGCAGGCCTGGCTGTTTTTG | 1315 | chr1 | ENST00000361632.8 |
| CSF3R | CCGGCTATGCCTACTCTCAAGAAATCTCGAGATTTCTTGAGAGTAGGCATAGTTTTTG | 1316 | chr1 | ENST00000361632.8 |
| CSF3R | CCGGCCAGCTTCACTCTGAAGAGTTCTCGAGAACTCTTCAGAGTGAAGCTGGTTTTTG | 1317 | chr1 | ENST00000361632.8 |
| CTF1 | CCGGGAGCAGCTGCTCCAGGAATATCTCGAGATATTCCTGGAGCAGCTGCTCTTTTTG | 1318 | chr16 | ENST00000279804.2 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| CTF1 | CCGGGTCTCTCCTTCCGCTTCTT TGCTCGAGCAAAGAAGCGGAA GGAGAGACTTTTTG | 1319 | chr16 | ENST00000279804.2 |
| CTF1 | CCGGTGTCTGTCTGTCTGCTCTT AGCTCGAGCTAAGAGCAGACA GACAGACATTTTTG | 1320 | chr16 | ENST00000279804.2 |
| CX3CL1 | CCGGCCCGGAGCTGTGGTAGTA ATTCTCGAGAATTACTACCACA GCTCCGGGTTTTTG | 1321 | chr16 | ENST00000006053.6 |
| CX3CL1 | CCGGGCTGCTGCCCTAACTCGA AATCTCGAGATTTCGAGTTAGG GCAGCAGCTTTTTG | 1322 | chr16 | ENST00000006053.6 |
| CX3CL1 | CCGGCGGTGTGACGAAATGCAA CATCTCGAGATGTTGCATTTCGT CACACCGTTTTTG | 1323 | chr16 | ENST00000006053.6 |
| CX3CR1 | CCGGTGGCCTGTGTCTAGTTGTT TGCTCGAGCAAACAACTAGACA CAGGCCATTTTTG | 1324 | chr3 | ENST00000399220.2 |
| CX3CR1 | CCGGTGGGATCCCTCATCCTCA TACCTCGAGGTATGAGGATGAG GGATCCCATTTTTG | 1325 | chr3 | ENST00000399220.2 |
| CX3CR1 | CCGGGCTTTGCTCATCCACTATC AACTCGAGTTGATAGTGGATGA GCAAAGCTTTTTG | 1326 | chr3 | ENST00000399220.2 |
| CXCL1 | CCGGACCTGCACACTGTCCTAT TATCTCGAGATAATAGGACAGT GTGCAGGTTTTTG | 1327 | chr4 | ENST00000395761.3 |
| CXCL1 | CCGGAGATGCTGAACAGTGACA AATCTCGAGATTTGTCACTGTTC AGCATCTTTTTG | 1328 | chr4 | ENST00000395761.3 |
| CXCL1 | CCGGGTTCTCCAGTCATTATGTT AACTCGAGTTAACATAATGACT GGAGAACTTTTTG | 1329 | chr4 | ENST00000395761.3 |
| CXCL10 | CCGGGTATATGTCAAGCCATAA TTGCTCGAGCAATTATGGCTTG ACATATACTTTTTG | 1330 | chr4 | ENST00000306602.2 |
| CXCL10 | CCGGACTCTACCCTGGCACTAT AATCTCGAGATTATAGTGCCAG GGTAGAGTTTTTG | 1331 | chr4 | ENST00000306602.2 |
| CXCL10 | CCGGCCTGTTAATCCAAGGTCT TTACTCGAGTAAAGACCTTGGA TTAACAGGTTTTTG | 1332 | chr4 | ENST00000306602.2 |
| CXCL11 | CCGGGCTGGTTACCATCGGAGT TTACTCGAGTAAACTCCGATGG TAACCAGCTTTTTG | 1333 | chr4 | ENST00000306621.7 |
| CXCL11 | CCGGGCAGTGAAAGTGGCAGAT ATTCTCGAGAATATCTGCCACT TTCACTGCTTTTTG | 1334 | chr4 | ENST00000306621.7 |
| CXCL11 | CCGGGAAGCAAGCAAGGCTTAT AATCTCGAGATTATAAGCCTTG CTTGCTTCTTTTTG | 1335 | chr4 | ENST00000306621.7 |
| CXCL12 | CCGGGCTTAGACTAAGGCCATT ATTCTCGAGAATAATGGCCTTA GTCTAAGCTTTTTG | 1336 | chr10 | ENST00000343575.10 |

TABLE 15-continued

5' to 3' (Forward) shRNA sequences for Silencing of Cytokine/Chemokine
Genes to Reduce the Incidence of CRS

| Target Gene Symbol | shRNA Forward Oligo Sequence | SEQ ID NO: | Location | Gene ID No. |
|---|---|---|---|---|
| CXCL12 | CCGGCTCTCACTATACCAGTAT AATCTCGAGATTATACTGGTAT AGTGAGAGTTTTTG | 1337 | chr10 | ENST00000343575.10 |
| CXCL12 | CCGGCAAACTGTGCCCTTCAGA TTGCTCGAGCAATCTGAAGGGC ACAGTTTGTTTTTG | 1338 | chr10 | ENST00000343575.10 |
| CXCL13 | CCGGGATTCCCTGATGCTGATA TTTCTCGAGAAATATCAGCATC AGGGAATCTTTTTG | 1339 | chr4 | ENST00000286758.4 |
| CXCL13 | CCGGAGGAATCCATGTAGTAGA TATCTCGAGATATCTACTACAT GGATTCCTTTTTG | 1340 | chr4 | ENST00000286758.4 |
| CXCL13 | CCGGAGGTGTTCTGGAGGTCTA TTACTCGAGTAATAGACCTCCA GAACACCTTTTTG | 1341 | chr4 | ENST00000286758.4 |
| CXCL14 | CCGGATTTGTCCATACGTCACT ATACTCGAGTATAGTGACGTAT GGACAAATTTTTG | 1342 | chr5 | ENST00000337225.5 |
| CXCL14 | CCGGCAAAGGACTTTGCAGATT AAACTCGAGTTTAATCTGCAAA GTCCTTTGTTTTTG | 1343 | chr5 | ENST00000337225.5 |
| CXCL14 | CCGGGCGCAGGGTCTACGAAGA ATACTCGAGTATTCTTCGTAGA CCCTGCGCTTTTTG | 1344 | chr5 | ENST00000337225.5 |
| CXCL16 | CCGGACATCCAGCCTACACGTA TTTCTCGAGAAATACGTGTAGG CTGGATGTTTTTG | 1345 | chr17 | ENST00000293778.10 |
| CXCL16 | CCGGTCTGAAGGTGCGAGGATT ATACTCGAGTATAATCCTCGCA CCTTCAGATTTTTG | 1346 | chr17 | ENST00000293778.10 |
| CXCL16 | CCGGTCCAGATCTGCCGGTTCA TTACTCGAGTAATGAACCGGCA GATCTGGATTTTTG | 1347 | chr17 | ENST00000293778.10 |
| CXCL17 | CCGGGCGCCCACTCTTCCAATT AAACTCGAGTTTAATTGGAAGA GTGGGCGCTTTTTG | 1348 | chr19 | ENST00000601181.5 |
| CXCL17 | CCGGTCCAGAGCCTGCCAGCAA TTTCTCGAGAAATTGCTGGCAG GCTCTGGATTTTTG | 1349 | chr19 | ENST00000601181.5 |
| CXCL17 | CCGGAGAATGTGAGTGCAAAG ATTGCTCGAGCAATCTTTGCAC TCACATTCTTTTTG | 1350 | chr19 | ENST00000601181.5 |
| CXCL2 | CCGGCTTGCACACTCTCCCATT ATACTCGAGTATAATGGGAGAG TGTGCAAGTTTTTG | 1351 | chr4 | ENST00000508487.2 |
| CXCL2 | CCGGGCAGATATTCTCTAGTCA TTTCTCGAGAAATGACTAGAGA ATATCTGCTTTTTG | 1352 | chr4 | ENST00000508487.2 |
| CXCL2 | CCGGATTTCTTCGTGATGACAT ATCCTCGAGGATATGTCATCAC GAAGAAATTTTTG | 1353 | chr4 | ENST00000508487.2 |
| CXCL3 | CCGGTTACGAGGGTTCTACTTA TTTCTCGAGAAATAAGTAGAAC CCTCGTAATTTTTG | 1354 | chr4 | ENST00000296026.4 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
| --- | --- | --- | --- | --- |
| CXCL3 | CCGGATTTAGTGGGAGACCATA ATGCTCGAGCATTATGGTCTCC CACTAAATTTTTG | 1355 | chr4 | ENST00000296026.4 |
| CXCL3 | CCGGACTGACAGGAGAGAAGT AAGACTCGAGTCTTACTTCTCTC CTGTCAGTTTTTG | 1356 | chr4 | ENST00000296026.4 |
| CXCL5 | CCGGTGAATTGTAGGTGACTAT TATCTCGAGATAATAGTCACCT ACAATTCATTTTTG | 1357 | chr4 | ENST00000296026.4 |
| CXCL5 | CCGGCAGACCACGCAAGGAGTT CATCTCGAGATGAACTCCTTGC GTGGTCTGTTTTTG | 1358 | chr4 | ENST00000296026.4 |
| CXCL5 | CCGGCGGGAAGGAAATTTGTCT TGACTCGAGTCAAGACAAATTT CCTTCCCGTTTTTG | 1359 | chr4 | ENST00000296026.4 |
| CXCL6 | CCGGTTTACCCTAGGATGCTAT TTACTCGAGTAAATAGCATCCT AGGGTAAATTTTTG | 1360 | chr4 | ENST00000226317.9 |
| CXCL6 | CCGGGTTGCACTTGTTTACGCG TTACTCGAGTAACGCGTAAACA AGTGCAACTTTTTG | 1361 | chr4 | ENST00000226317.9 |
| CXCL6 | CCGGGCTGTGGATTTCGTATGG AAACTCGAGTTTCCATACGAAA TCCACAGCTTTTTG | 1362 | chr4 | ENST00000226317.9 |
| CXCL8 | CCGGTGCGCCAACACAGAAATT ATTCTCGAGAATAATTTCTGTGT TGGCGCATTTTTG | 1363 | chr4 | ENST00000307407.7 |
| CXCL8 | CCGGCAAGAGAATATCCGAACT TTACTCGAGTAAAGTTCGGATA TTCTCTTGTTTTTG | 1364 | chr4 | ENST00000307407.7 |
| CXCL8 | CCGGTGCACGGGAGAATATACA AATCTCGAGATTTGTATATTCTC CCGTGCATTTTTG | 1365 | chr4 | ENST00000307407.7 |
| CXCL9 | CCGGCCAAAGGAGGATGGCAT ATAACTCGAGTTATATGCCATC CTCCTTTGGTTTTTG | 1366 | chr4 | ENST00000264888.5 |
| CXCL9 | CCGGCCAAACGTTAAGAATTGT TAACTCGAGTTAACAATTCTTA ACGTTTGGTTTTTG | 1367 | chr4 | ENST00000264888.5 |
| CXCL9 | CCGGGATGTGAAGGAACTGATT AAACTCGAGTTTAATCAGTTCC TTCACATCTTTTTG | 1368 | chr4 | ENST00000264888.5 |
| CXCR1 | CCGGCTTGGCACGTCATCGTGT TACCTCGAGGTAACACGATGAC GTGCCAAGTTTTTG | 1369 | chr2 | ENST00000295683.2 |
| CXCR1 | CCGGACCCACTAACTGGCTAAT TAGCTCGAGCTAATTAGCCAGT TAGTGGGTTTTTG | 1370 | chr2 | ENST00000295683.2 |
| CXCR1 | CCGGGAGACACTCAACAAGTAT GTTCTCGAGAACATACTTGTTG AGTGTCTCTTTTTG | 1371 | chr2 | ENST00000295683.2 |
| CXCR2 | CCGGGAAGCGCTACTTGGTCAA ATTCTCGAGAATTTGACCAAGT AGCGCTTCTTTTTG | 1372 | chr2 | ENST00000318507.6 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
| --- | --- | --- | --- | --- |
| CXCR2 | CCGGGCCACTAAATTGACACTTAAACTCGAGTTTAAGTGTCAATTTAGTGGCTTTTTG | 1373 | chr2 | ENST00000318507.6 |
| CXCR2 | CCGGCCCTGGAAATCAACAAGTATTCTCGAGAATACTTGTTGATTTCCAGGGTTTTTG | 1374 | chr2 | ENST00000318507.6 |
| CXCR3 | CCGGCCTTCTCATTTGGAAACTAAACTCGAGTTTAGTTTCCAAATGAGAAGGTTTTTG | 1375 | chrX | ENST00000373693.3 |
| CXCR3 | CCGGCGCTACCTGAACATAGTTCATCTCGAGATGAACTATGTTCAGGTAGCGTTTTTG | 1376 | chrX | ENST00000373693.3 |
| CXCR3 | CCGGGAGTACAAGGCATGGCGTAGACTCGAGTCTACGCCATGCCTTGTACTCTTTTTG | 1377 | chrX | ENST00000373693.3 |
| CXCR4 | CCGGCTATTCCCGACTTCATCTTTGCTCGAGCAAAGATGAAGTCGGGAATAGTTTTTG | 1378 | chr2 | ENST00000409817.1 |
| CXCR4 | CCGGGCGTGTAGTGAATCACGTAAACTCGAGTTTACGTGATTCACTACACGCTTTTTG | 1379 | chr2 | ENST00000409817.1 |
| CXCR4 | CCGGCCTGTTCTTAAGACGTGATTTCTCGAGAAATCACGTCTTAAGAACAGGTTTTTG | 1380 | chr2 | ENST00000409817.1 |
| CXCR6 | CCGGGCTTGCTCATCTGGGTGATATCTCGAGATATCACCCAGATGAGCAAGCTTTTTG | 1381 | chr3 | ENST00000304552.4 |
| CXCR6 | CCGGTACTGGGCATCTACACTATTACTCGAGTAATAGTGTAGATGCCCAGTATTTTTG | 1382 | chr3 | ENST00000304552.4 |
| CXCR6 | CCGGTTATCTATGGCAATGTCTTTACTCGAGTAAAGACATTGCCATAGATAATTTTTG | 1383 | chr3 | ENST00000304552.4 |
| EBI3 | CCGGTGAACTGTCACTGTGAGATATCTCGAGATATCTCACAGTGACAGTTCATTTTTG | 1384 | chr19 | ENST00000221847.5 |
| EBI3 | CCGGATGTACTACTCTCTCCTTTACCTCGAGGTAAAGGAGAGAGTAGTACATTTTTG | 1385 | chr19 | ENST00000221847.5 |
| EBI3 | CCGGGCCTTTCATAACAGAGCACATCTCGAGATGTGCTCTGTTATGAAAGGCTTTTG | 1386 | chr19 | ENST00000221847.5 |
| EDN1 | CCGGCCATGAGAAACAGCGTCAAATCTCGAGATTTGACGCTGTTTCTCATGGTTTTTG | 1387 | chr6 | ENST00000379375.5 |
| EDN1 | CCGGGCTCGTCCCTGATGGATAAGCTCGAGCTTATCCATCAGGGACGAGCTTTTTG | 1388 | chr6 | ENST00000379375.5 |
| EDN1 | CCGGAGACAAGAAGTGCTGGAATTTCTCGAGAAATTCCAGCACTTCTTGTCTTTTTG | 1389 | chr6 | ENST00000379375.5 |
| ELANE | CCGGGCACTGCGTGGCGAATGTAAACTCGAGTTTACATTCGCCACGCAGTGCTTTTTG | 1390 | chr19 | ENST00000263621.1 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| ELANE | CCGGTGCTCAACGACATCGTGATTCCTCGAGGAATCACGATGTCGTTGAGCATTTTTG | 1391 | chr19 | ENST00000263621.1 |
| ELANE | CCGGCAACGGGCTAATCCACGGAATCTCGAGATTCCGTGGATTAGCCCGTTGTTTTTG | 1392 | chr19 | ENST00000263621.1 |
| ENG | CCGGGCAGGTGTCAGCAAGTATGATCTCGAGATCATACTTGCTGACACCTGCTTTTTG | 1393 | chr9 | ENST00000344849.4 |
| ENG | CCGGGCAGGTGTCAGCAAGTATGATCTCGAGATCATACTTGCTGACACCTGCTTTTTG | 1394 | chr9 | ENST00000344849.4 |
| ENG | CCGGGTCTTGCAGAAACAGTCCATTCTCGAGAATGGACTGTTTCTGCAAGACTTTTTG | 1395 | chr9 | ENST00000344849.4 |
| EPO | CCGGCCCAGACACCAAAGTTAATTTCTCGAGAAATTAACTTTGGTGTCTGGGTTTTTG | 1396 | chr7 | ENST00000252723.2 |
| EPO | CCGGTGCAGCTGCATGTGGATAAAGCTCGAGCTTTATCCACATGCAGCTGCATTTTTG | 1397 | chr7 | ENST00000252723.2 |
| EPO | CCGGAGAGCAACTCTGAGATCTAAGCTCGAGCTTAGATCTCAGAGTTGCTCTTTTTG | 1398 | chr7 | ENST00000252723.2 |
| FAM3B | CCGGTTGGAACTCCCTTCCGAAATTCTCGAGAATTTCGGAAGGGAGTTCCAATTTTTG | 1399 | chr21 | ENST00000357985.6 |
| FAM3B | CCGGTAAATCCAACAGCCCATATTTCTCGAGAAATATGGGCTGTTGGATTTATTTTTG | 1400 | chr21 | ENST00000357985.6 |
| FAM3B | CCGGTCAGGTCTAGCTGGGTATTTACTCGAGTAAATACCCAGCTAGACCTGATTTTTG | 1401 | chr21 | ENST00000357985.6 |
| FAM3C | CCGGCTTGGTGTGTGCATGAGTATTCTCGAGAATACTCATGCACACACCAAGTTTTTG | 1402 | chr7 | ENST00000359943.7 |
| FAM3C | CCGGGAGGAGATGTGGCACCATTTACTCGAGTAAATGGTGCCACATCTCCTCTTTTTG | 1403 | chr7 | ENST00000359943.7 |
| FAM3C | CCGGGCCATACAAGATGGAACAATACTCGAGTATTGTTCCATCTTGTATGGCTTTTTG | 1404 | chr7 | ENST00000359943.7 |
| FAM3D | CCGGCACCTAGTGAAATTCCTTAAACTCGAGTTTAAGGAATTTCACTAGGTGTTTTTG | 1405 | chr3 | ENST00000358781.6 |
| FAM3D | CCGGCATGTACTCTGGAGATGTTATCTCGAGATAACATCTCCAGAGTACATGTTTTTG | 1406 | chr3 | ENST00000358781.6 |
| FAM3D | CCGGCAATGTGGGCAGAGGCCTAAACTCGAGTTTAGGCCTCTGCCCACATTGTTTTTG | 1407 | chr3 | ENST00000358781.6 |
| FAS | CCGGGCGTATGACACATTGATTAAACTCGAGTTTAATCAATGTGTCATACGCTTTTTG | 1408 | chr10 | ENST00000355740.6 |

TABLE 15-continued

5' to 3' (Forward) shRNA sequences for Silencing of Cytokine/Chemokine
Genes to Reduce the Incidence of CRS

| Target Gene Symbol | shRNA Forward Oligo Sequence | SEQ ID NO: | Location | Gene ID No. |
|---|---|---|---|---|
| FAS | CCGGCCTGAAACAGTGGCAATA AATCTCGAGATTATTGCCACT GTTTCAGGTTTTTG | 1409 | chr10 | ENST00000355740.6 |
| FAS | CCGGCTATCATCCTCAAGGACA TTACTCGAGTAATGTCCTTGAG GATGATAGTTTTTG | 1410 | chr10 | ENST00000355740.6 |
| FASLG | CCGGGACTAGAGGCTTGCATAA TAACTCGAGTTATTATGCAAGC CTCTAGTCTTTTTG | 1411 | chr1 | ENST00000367721.2 |
| FASLG | CCGGACTGGGCTGTACTTTGTA TATCTCGAGATATACAAAGTAC AGCCCAGTTTTTG | 1412 | chr1 | ENST00000367721.2 |
| FASLG | CCGGTGAGCTCTCTCTGGTCAA TTTCTCGAGAAATTGACCAGAG AGAGCTCATTTTTG | 1413 | chr1 | ENST00000367721.2 |
| FGF2 | CCGGGAAACGAACTGGGCAGT ATAACTCGAGTTATACTGCCCA GTTCGTTTCTTTTTG | 1414 | chr4 | ENST00000608478.1 |
| FGF2 | CCGGTATAGCTCAGTTTGGATA ATTCTCGAGAATTATCCAAACT GAGCTATATTTTTG | 1415 | chr4 | ENST00000608478.1 |
| FGF2 | CCGGTGAACGATTGGAATCTAA TAACTCGAGTTATTAGATTCCA ATCGTTCATTTTTG | 1416 | chr4 | ENST00000608478.1 |
| FLT3LG | CCGGCTGTCTGACTACCTGCTTC AACTCGAGTTGAAGCAGGTAGT CAGACAGTTTTTG | 1417 | chr19 | ENST00000594009.5 |
| FLT3LG | CCGGTCCTCCGACTTCGCTGTC AAAACTCGAGTTTGACAGCGAAG TCGGAGGATTTTTG | 1418 | chr19 | ENST00000594009.5 |
| FLT3LG | CCGGGCTTCGTCCAGACCAACA TCTCTCGAGAGATGTTGGTCTG GACGAAGCTTTTTG | 1419 | chr19 | ENST00000594009.5 |
| FOXP3 | CCGGAGCTGGAGTTCCGCAAGA AACCTCGAGGTTTCTTGCGGAA CTCCAGCTTTTTG | 1420 | chrX | ENST00000376207.8 |
| FOXP3 | CCGGTCCTACCCACTGCTGGCA AATCTCGAGATTTGCCAGCAGT GGGTAGGATTTTTG | 1421 | chrX | ENST00000376207.8 |
| FOXP3 | CCGGTGTCCCTCACTCAACACA AACCTCGAGGTTTGTGTTGAGT GAGGGACATTTTTG | 1422 | chrX | ENST00000376207.8 |
| FOXP3 | CCGGCACACGCATGTTTGCCTT CTTCTCGAGAAGAAGGCAAACA TGCGTGTGTTTTTG | 1423 | chrX | ENST00000376207.8 |
| FZD4 | CCGGCGTGTGTGATTGCCTGTT ATTCTCGAGAATAACAGGCAAT CACACACGTTTTTG | 1424 | chr11 | ENST00000531380.1 |
| FZD4 | CCGGTCTCAGTATGTGCTATAA TATCTCGAGATATTATAGCACA TACTGAGATTTTTG | 1425 | chr11 | ENST00000531380.1 |
| FZD4 | CCGGTTCTCAGTATGTGCTATA ATACTCGAGTATTATAGCACAT ACTGAGAATTTTTG | 1426 | chr11 | ENST00000531380.1 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| GATA3 | CCGGAGCCTAAACGCGATGGAT ATACTCGAGTATATCCATCGCG TTTAGGCTTTTTG | 1427 | chr10 | ENST00000346208.4 |
| GATA3 | CCGGCCCAAGAACAGCTCGTTT AACCTCGAGGTTAAACGAGCTG TTCTTGGGTTTTTG | 1428 | chr10 | ENST00000346208.4 |
| GATA3 | CCGGGCCAAGAAGTTTAAGGAA TATCTCGAGATATTCCTTAAACT TCTTGGCTTTTTG | 1429 | chr10 | ENST00000346208.4 |
| GATA3 | CCGGCCCTGTAATTGTTGTTTGT ATCTCGAGATACAAACAACAAT TACAGGGTTTTTG | 1430 | chr10 | ENST00000346208.4 |
| GBP1 | CCGGCCAGATGAGTACCTGACA TACCTCGAGGTATGTCAGGTAC TCATCTGGTTTTTG | 1431 | chr1 | ENST00000370473.4 |
| GBP1 | CCGGCGACGAAAGGCATGTACC ATACTCGAGTATGGTACATGCC TTTCGTCGTTTTTG | 1432 | chr1 | ENST00000370473.4 |
| GBP1 | CCGGCGACGAAAGGCATGTACC ATACTCGAGTATGGTACATGCC TTTCGTCGTTTTTG | 1433 | chr1 | ENST00000370473.4 |
| GDF1 | CCGGGTTCACCAAGCTCAACAT TTACTCGAGTAAATGTTGAGCT TGGTGAACTTTTTG | 1434 | chr19 | ENST00000247005.7 |
| GDF1 | CCGGGAGTTCACCAAGCTCAAC ATTCTCGAGAATGTTGAGCTTG GTGAACTCTTTTTG | 1435 | chr19 | ENST00000247005.7 |
| GDF1 | CCGGCCCTTATGAACCTCTACT GGTCTCGAGACCAGTAGAGGTT CATAAGGGTTTTTG | 1436 | chr19 | ENST00000247005.7 |
| GDF10 | CCGGCAGGATAATCGTGGTGTA AATCTCGAGATTTACACCACGA TTATCCTGTTTTTG | 1437 | chr10 | ENST00000580279.1 |
| GDF10 | CCGGCGACCAGAAGGCCGTGTA TTTCTCGAGAAATACACGGCCT TCTGGTCGTTTTTG | 1438 | chr10 | ENST00000580279.1 |
| GDF10 | CCGGCTGTCCGCCAGTGCATCA TTACTCGAGTAATGATGCACTG GCGGACAGTTTTTG | 1439 | chr10 | ENST00000580279.1 |
| GDF11 | CCGGCCTGCAGATCTTGCGACT AAACTCGAGTTTAGTCGCAAGA TCTGCAGGTTTTTG | 1440 | chr12 | ENST00000257868.9 |
| GDF11 | CCGGGATCGCTGTGGCTGCTCT TAACTCGAGTTAAGAGCAGCCA CAGCGATCTTTTTG | 1441 | chr12 | ENST00000257868.9 |
| GDF11 | CCGGGAGATGTAGAGACAGTG ATAGCTCGAGCTATCACTGTCT CTACATCTCTTTTTG | 1442 | chr12 | ENST00000257868.9 |
| GDF15 | CCGGAGACTCCAGATTCCGAGA GTTCTCGAGAACTCTCGGAATC TGGAGTCTTTTTG | 1443 | chr19 | ENST00000252809.3 |
| GDF15 | CCGGGCTCCAGACCTATGATGA CTTCTCGAGAAGTCATCATAGG TCTGGAGCTTTTTG | 1444 | chr19 | ENST00000252809.3 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| GDF15 | CCGGAGAGCTGGGAAGATTCGAACACTCGAGTGTTCGAATCTTCCCAGCTCTTTTTTG | 1445 | chr19 | ENST00000252809.3 |
| GDF2 | CCGGCAACAGGTACACGTCCGATAACTCGAGTTATCGGACGTGTACCTGTTGTTTTTG | 1446 | chr10 | ENST00000581492.2 |
| GDF2 | CCGGTGAAAGGAAGCGTGGTCATTTCTCGAGAAATGACCACGCTTCCTTTCATTTTTG | 1447 | chr10 | ENST00000581492.2 |
| GDF2 | CCGGTATGAAGCCTACGAGTGTAAGCTCGAGCTTACACTCGTAGGCTTCATATTTTTG | 1448 | chr10 | ENST00000581492.2 |
| GDF3 | CCGGACCGTCACCAGCTATTCATTACTCGAGTAATGAATAGCTGGTGACGGTTTTTG | 1449 | chr12 | ENST00000329913.3 |
| GDF3 | CCGGCTCTCAACAGCTCCAATTATGCTCGAGCATAATTGGAGCTGTTGAGAGTTTTTG | 1450 | chr12 | ENST00000329913.3 |
| GDF3 | CCGGTTGGGCCAGGCAGTCCAATTTCTCGAGAAATTGGACTGCCTGGCCCAATTTTTG | 1451 | chr12 | ENST00000329913.3 |
| GDF5 | CCGGCAACACCATCACCAGCTTTATCTCGAGATAAAGCTGGTGATGGTGTTGTTTTTG | 1452 | chr20 | ENST00000374369.7 |
| GDF5 | CCGGATGAGACTCAGCCCACCATTTCTCGAGAAATGGTGGGCTGAGTCTCATTTTTG | 1453 | chr20 | ENST00000374369.7 |
| GDF5 | CCGGTGAGTGTGACTTGGGCTAAAGCTCGAGCTTTAGCCCAAGTCACACTCATTTTTG | 1454 | chr20 | ENST00000374369.7 |
| GDF6 | CCGGGACTCCCATCAGCATTCTATACTCGAGTATAGAATGCTGATGGGAGTCTTTTTG | 1455 | chr8 | ENST00000287020.6 |
| GDF6 | CCGGCGAGTACATGCTGTCAATCTACTCGAGTAGATTGACAGCATGTACTCGTTTTTG | 1456 | chr8 | ENST00000287020.6 |
| GDF6 | CCGGCAGTCTTCCAAGTCGGCTAATCTCGAGATTAGCCGACTTGGAAGACTGTTTTTG | 1457 | chr8 | ENST00000287020.6 |
| GDF7 | CCGGGCAGAGGAAAGAGAGCTTATTCTCGAGAATAAGCTCTCTTTCCTCTGCTTTTTG | 1458 | chr2 | ENST00000272224.4 |
| GDF7 | CCGGGTTCGACGTGTCCAGCCTTAACTCGAGTTAAGGCTGGACACGTCGAACTTTTTG | 1459 | chr2 | ENST00000272224.4 |
| GDF7 | CCGGCCACTTCATGATGTCGCTTTACTCGAGTAAAGCGACATCATGAAGTGGTTTTTG | 1460 | chr2 | ENST00000272224.4 |
| GDF9 | CCGGGATGGCTCAATTGCCTATAAACTCGAGTTTATAGGCAATTGAGCCATCTTTTTG | 1461 | chr5 | ENST00000378673.2 |
| GDF9 | CCGGCCATCAGTGGAACTGCTATTTCTCGAGAAATAGCAGTTCCACTGATGGTTTTTG | 1462 | chr5 | ENST00000378673.2 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| GDF9 | CCGGGAGTGAATACTTCAGACAATTCTCGAGAATTGTCTGAAGTATTCACTCTTTTTG | 1463 | chr5 | ENST00000378673.2 |
| GPI | CCGGCGTCTGGTATGTCTCCAACATCTCGAGATGTTGGAGACATACCAGACGTTTTTG | 1464 | chr19 | ENST00000356487.9 |
| GPI | CCGGCGTCTGGTATGTCTCCAACATCTCGAGATGTTGGAGACATACCAGACGTTTTTG | 1465 | chr19 | ENST00000356487.9 |
| GPI | CCGGGCGGATGTTCAATGGTGAGAACTCGAGTTCTCACCATTGAACATCCGCTTTTTG | 1466 | chr19 | ENST00000356487.9 |
| GREM1 | CCGGGCAGTGTCGTTGCATATCCATCTCGAGATGGATATGCAACGACACTGCTTTTTG | 1467 | chr15 | ENST00000622074.1 |
| GREM1 | CCGGACAGCCACCTACCAAGAAGAACTCGAGTTCTTCTTGGTAGGTGGCTGTTTTTTG | 1468 | chr15 | ENST00000622074.1 |
| GREM1 | CCGGCAACAGTCGCACCATCATCAACTCGAGTTGATGATGGTGCGACTGTTGTTTTTG | 1469 | chr15 | ENST00000622074.1 |
| GREM2 | CCGGGCTGTGAAGGAAGGAAATTTACTCGAGTAAATTTCCTTCCTTCACAGCTTTTTG | 1470 | chr1 | ENST00000318160.4 |
| GREM2 | CCGGCAAGGTGCATTTCTGTCATTTCTCGAGAAATGACAGAAATGCACCTTGTTTTTG | 1471 | chr1 | ENST00000318160.4 |
| GREM2 | CCGGCGGAAGTAGACGTAACTTATTCTCGAGAATAAGTTACGTCTACTTCCGTTTTTG | 1472 | chr1 | ENST00000318160.4 |
| GRN | CCGGGCCCTGATAGTCAGTTCGAATCTCGAGATTCGAACTGACTATCAGGGCTTTTTG | 1473 | chr17 | ENST00000053867.7 |
| GRN | CCGGGCCCTGATAGTCAGTTCGAATCTCGAGATTCGAACTGACTATCAGGGCTTTTTG | 1474 | chr17 | ENST00000053867.7 |
| GRN | CCGGCTTCCAAAGATCAGGTAACAACTCGAGTTGTTACCTGATCTTTGGAAGTTTTTG | 1475 | chr17 | ENST00000053867.7 |
| HAX1 | CCGGACAGACACTTCGGGACTCAATCTCGAGATTGAGTCCCGAAGTGTCTGTTTTTTG | 1476 | chr1 | ENST00000328703.11 |
| HAX1 | CCGGCCAGCCCAAATCCTATTTCAACTCGAGTTGAAATAGGATTTGGGCTGGTTTTTG | 1477 | chr1 | ENST00000328703.11 |
| HAX1 | CCGGCCAGAGGCCATTTCATAGGTTCTCGAGAACCTATGAAATGGCCTCTGGTTTTTG | 1478 | chr1 | ENST00000328703.11 |
| HFE2 | CCGGGACATGATCATTAGCCATAAGCTCGAGCTTATGGCTAATGATCATGTCTTTTTG | 1479 | chr1 | ENST00000336751.10 |
| HFE2 | CCGGGCCTACATTGGCACAACTATACTCGAGTATAGTTGTGCCAATGTAGGCTTTTTG | 1480 | chr1 | ENST00000336751.10 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| HFE2 | CCGGGAAGCTCACCATCATATT TAACTCGAGTTAAATATGATGG TGAGCTTCTTTTTG | 1481 | chr1 | ENST00000336751.10 |
| HMGB1 | CCGGGATGCAGCTTATACGAAA TAACTCGAGTTATTTCGTATAA GCTGCATCTTTTTG | 1482 | chr13 | ENST00000339872.8 |
| HMGB1 | CCGGGTTGGTGCACAGCACAAA TTACTCGAGTAATTTGTGCTGTG CACCAACTTTTTG | 1483 | chr13 | ENST00000339872.8 |
| HMGB1 | CCGGAGAAGATGATGATGATGA ATACTCGAGTATTCATCATCAT CATCTTCTTTTTG | 1484 | chr13 | ENST00000339872.8 |
| HYAL2 | CCGGCCTGCCAGTACCTCAAAG ATTCTCGAGAATCTTTGAGGTA CTGGCAGGTTTTTG | 1485 | chr3 | ENST00000357750.8 |
| HYAL2 | CCGGCCTGCCAGTACCTCAAAG ATTCTCGAGAATCTTTGAGGTA CTGGCAGGTTTTTG | 1486 | chr3 | ENST00000357750.8 |
| HYAL2 | CCGGCTGGACCTGAATGCCTTT GATCTCGAGATCAAAGGCATTC AGGTCCAGTTTTTG | 1487 | chr3 | ENST00000357750.8 |
| ICAM3 | CCGGGTCCAGCTCACGAGGCAA ATACTCGAGTATTTGCCTCGTG AGCTGGACTTTTTG | 1488 | chr19 | ENST00000160262.9 |
| ICAM3 | CCGGCCAGCTCAACTTCAGCTA AATCTCGAGATTTAGCTGAAGT TGAGCTGGTTTTTG | 1489 | chr19 | ENST00000160262.9 |
| ICAM3 | CCGGGCACTTGAAATGGAAAGA TAACTCGAGTTATCTTTCCATTT CAAGTGCTTTTTG | 1490 | chr19 | ENST00000160262.9 |
| ICAM3 | CCGGGAGCGGCAGTTACCATGT TAGCTCGAGCTAACATGGTAAC TGCCGCTCTTTTTG | 1491 | chr19 | ENST00000160262.9 |
| ICOS | CCGGGCACGACCCTAACGGTGA ATACTCGAGTATTCACCGTTAG GGTCGTGCTTTTTG | 1492 | ch2 | ENST00000316386.10 |
| ICOS | CCGGGTCCGCATTTCACTATCA TACCTCGAGGTATGATAGTGAA ATGCGGACTTTTTG | 1493 | ch2 | ENST00000316386.10 |
| ICOS | CCGGCCATTCTCATGCCAACTA TTACTCGAGTAATAGTTGGCAT GAGAATGGTTTTTG | 1494 | ch2 | ENST00000316386.10 |
| ICOS | CCGGCACAGATGTGACCCTATA ATACTCGAGTATTATAGGGTCA CATCTGTGTTTTTG | 1495 | ch2 | ENST00000316386.10 |
| IFNA10 | CCGGTGTAAAGAAGTGTCGTGT ATACTCGAGTATACACGACACT TCTTTACATTTTTG | 1496 | chr9 | ENST00000357374.2 |
| IFNA10 | CCGGATAACCACGACGCGTTGA ATCCTCGAGGATTCAACGCGTC GTGGTTATTTTTTG | 1497 | chr9 | ENST00000357374.2 |
| IFNA10 | CCGGCCTGGGACAAATGGGAA GAATCTCGAGATTCTTCCCATTT GTCCCAGGTTTTTG | 1498 | chr9 | ENST00000357374.2 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| IFNA14 | CCGGCTGGGCTGTAATCTGTCTCAACTCGAGTTGAGACAGATTACAGCCCAGTTTTTG | 1499 | chr9 | ENST00000380222.3 |
| IFNA14 | CCGGCCTGAATAACAGGAGGACTTTCTCGAGAAAGTCCTCCTGTTATTCAGGTTTTTG | 1500 | chr9 | ENST00000380222.3 |
| IFNA14 | CCGGGCAGCAGACCTTCAATCTCTTCTCGAGAAGAGATTGAAGGTCTGCTGCTTTTTG | 1501 | chr9 | ENST00000380222.3 |
| IFNA16 | CCGGTGTAAAGAAGCATCGTGTTTACTCGAGTAAACACGATGCTTCTTTACATTTTTG | 1502 | chr9 | ENST00000380216.1 |
| IFNA16 | CCGGATGATCCTCATTGATTAATACCTCGAGGTATTAATCAATGAGGATCATTTTTG | 1503 | chr9 | ENST00000380216.1 |
| IFNA16 | CCGGCCTGAAGGACAGATATGATTTCTCGAGAAATCATATCTGTCCTTCAGGTTTTTG | 1504 | chr9 | ENST00000380216.1 |
| IFNA2 | CCGGGCACAGTGGTTAATGTAATAACTCGAGTTATTACATTAACCACTGTGCTTTTTG | 1505 | chr9 | ENST00000380206.3 |
| IFNA2 | CCGGTATGACCATGACACGATTTAACTCGAGTTAAATCGTGTCATGGTCATATTTTTG | 1506 | chr9 | ENST00000380206.3 |
| IFNA2 | CCGGCCATGCTGACTGATCCATTATCTCGAGATAATGGATCAGTCAGCATGGTTTTTG | 1507 | chr9 | ENST00000380206.3 |
| IFNA5 | CCGGACTTGGGATGAGACACTTCTACTCGAGTAGAAGTGTCTCATCCCAAGTTTTTG | 1508 | chr9 | ENST00000610521.1 |
| IFNA5 | CCGGAGTGGAAGACACTCCTCTGATCTCGAGATCAGAGGAGTGTCTTCCACTTTTTG | 1509 | chr9 | ENST00000610521.1 |
| IFNA5 | CCGGTCAACTGCAAGTCAATCTGTTCTCGAGAACAGATTGACTTGCAGTTGATTTTTG | 1510 | chr9 | ENST00000610521.1 |
| IFNA6 | CCGGGACAGACATGACTTCAGATTTCTCGAGAAATCTGAAGTCATGTCTGTCTTTTTG | 1511 | chr9 | ENST00000380210.1 |
| IFNA6 | CCGGCTGTCCTCCATGAGGTGATTCCTCGAGGAATCACCTCATGGAGGACAGTTTTTG | 1512 | chr9 | ENST00000380210.1 |
| IFNA6 | CCGGAGGCTTCTAGACAAACTCTATCTCGAGATAGAGTTTGTCTAGAAGCCTTTTTG | 1513 | chr9 | ENST00000380210.1 |
| IFNA8 | CCGGTAACTATCTATAGGGCTTAAACTCGAGTTTAAGCCCTATAGATAGTTATTTTTG | 1514 | chr9 | ENST00000380210.1 |
| IFNA8 | CCGGCCAGGAGGAGTTTGATGATAACTCGAGTTATCATCAAACTCCTCCTGGTTTTTG | 1515 | chr9 | ENST00000380205.1 |
| IFNA8 | CCGGGACCTGGTACAACACGGAAATCTCGAGATTTCCGTGTTGTACCAGGTCTTTTTG | 1516 | chr9 | ENST00000380205.1 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| IFNAR1 | CCGGGCCAAGATTCAGGAAATTATTCTCGAGAATAATTTCCTGAATCTTGGCTTTTTG | 1517 | chr21 | ENST00000270139.7 |
| IFNAR1 | CCGGGCTCTCCCGTTTGTCATTTATCTCGAGATAAATGACAAACGGGAGAGCTTTTTG | 1518 | chr21 | ENST00000270139.7 |
| IFNAR1 | CCGGATGAACTGTGTCAAGTATAAGCTCGAGCTTATACTTGACACAGTTCATTTTTG | 1519 | chr21 | ENST00000270139.7 |
| IFNAR2 | CCGGGAGTGGAAATTTCACCTATATCTCGAGATATAGGTGAAATTTCCACTCTTTTTG | 1520 | chr21 | ENST00000342136.8 |
| IFNAR2 | CCGGTGTATATCAGCCTCGTGTTTGCTCGAGCAAACACGAGGCTGATATACATTTTTG | 1521 | chr21 | ENST00000342136.8 |
| IFNAR2 | CCGGGCAAATACCACAAGATCATTTCTCGAGAAATGATCTTGTGGTATTTGCTTTTTG | 1522 | chr21 | ENST00000342136.8 |
| IFNB1 | CCGGATTGAATGGGAGGCTTGAATACTCGAGTATTCAAGCCTCCCATTCAATTTTTG | 1523 | chr9 | ENST00000380232.3 |
| IFNB1 | CCGGCCTACAAAGAAGCAGCAATTTCTCGAGAAATTGCTGCTTCTTTGTAGGTTTTTG | 1524 | chr9 | ENST00000380232.3 |
| IFNB1 | CCGGCTAATGTCTATCATCAGATAACTCGAGTTATCTGATGATAGACATTAGTTTTTG | 1525 | chr9 | ENST00000380232.3 |
| IFNE | CCGGGGTAGTGATAACCTTAGATTACTCGAGTAATCTAAGGTTATCACTACCTTTTTG | 1526 | chr9 | ENST00000448696.4 |
| IFNE | CCGGAGCCTCTTCAGGGCAAATATTCTCGAGAATATTTGCCCTGAAGAGGCTTTTTG | 1527 | chr9 | ENST00000448696.4 |
| IFNE | CCGGCATAGAGTGGTAATACAATTTCTCGAGAAATTGTATTACCACTCTATGTTTTTG | 1528 | chr9 | ENST00000448696.4 |
| IFNG | CCGGGGTTGTCCTGCCTGCAATATTCTCGAGAATATTGCAGGCAGGACAACCTTTTTG | 1529 | chr12 | ENST00000229135.3 |
| IFNG | CCGGCATTCAGATGTAGCGGATAATCTCGAGATTATCCGCTACATCTGAATGTTTTTG | 1530 | chr12 | ENST00000229135.3 |
| IFNG | CCGGTGTTACTGCCAGGACCCATATCTCGAGATATGGGTCCTGGCAGTAACATTTTTG | 1531 | chr12 | ENST00000229135.3 |
| IFNGR1 | CCGGACGAGCAGGAAGTCGATTATGCTCGAGCATAATCGACTTCCTGCTCGTTTTTG | 1532 | chr6 | ENST00000367739.8 |
| IFNGR1 | CCGGCATGAACCCTATCGTATATTGCTCGAGCAATATACGATAGGGTTCATGTTTTTG | 1533 | chr6 | ENST00000367739.8 |
| IFNGR1 | CCGGCGGAAGTGAGATCCAGTATAACTCGAGTTATACTGGATCTCACTTCCGTTTTTG | 1534 | chr6 | ENST00000367739.8 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| IFNK | CCGGGAGATTGTGGCTACGCAAATGCTCGAGCATTTGCGTAGCCACAATCTCTTTTTG | 1535 | chr9 | ENST00000276943.2 |
| IFNK | CCGGCTGTTCAGATTCAAGATTATTCTCGAGAATAATCTTGAATCTGAACAGTTTTTG | 1536 | chr9 | ENST00000276943.2 |
| IFNK | CCGGTCAGCCAACACACCTTCAAATCTCGAGATTTGAAGGTGTGTTGGCTGATTTTTG | 1537 | chr9 | ENST00000276943.2 |
| IFNL1 | CCGGCTCACGCGAGACCTCAAATATCTCGAGATATTTGAGGTCTCGCGTGAGTTTTTG | 1538 | chr19 | ENST00000333625.2 |
| IFNL1 | CCGGGCCACATTGGCAGGTTCAAATCTCGAGATTTGAACCTGCCAATGTGGCTTTTTG | 1539 | chr19 | ENST00000333625.2 |
| IFNL1 | CCGGGAGTTGCAGCTCTCCTGTCTTCTCGAGAAGACAGGAGAGCTGCAACTCTTTTTG | 1540 | chr19 | ENST00000333625.2 |
| IFNL3 | CCGGAGGGCCAAAGATGCCTTAGAACTCGAGTTCTAAGGCATCTTTGGCCCTTTTTG | 1541 | chr19 | ENST00000413851.2 |
| IFNL3 | CCGGGCCTTTAAGAGGGCCAAAGATCTCGAGATCTTTGGCCCTCTTAAAGGCTTTTTG | 1542 | chr19 | ENST00000413851.2 |
| IFNL3 | CCGGTGCCACATAGCCCAGTTCAAGCTCGAGCTTGAACTGGGCTATGTGGCATTTTG | 1543 | chr19 | ENST00000413851.2 |
| IFNW1 | CCGGAGACTCTTATTTCGGCTTTAACTCGAGTTAAAGCCGAAATAAGAGTCTTTTTG | 1544 | chr9 | ENST00000380229.3 |
| IFNW1 | CCGGTCAGTCCCTAAGATGTTATTTCTCGAGAAATAACATCTTAGGGACTGATTTTTG | 1545 | chr9 | ENST00000380229.3 |
| IFNW1 | CCGGCGGTATATTAAGCCAGTATATCTCGAGATATACTGGCTTAATATACCGTTTTTG | 1546 | chr9 | ENST00000380229.3 |
| IL10 | CCGGAGCTTCTCTGTGAACGATTTACTCGAGTAAATCGTTCACAGAGAAGCTTTTTG | 1547 | chr | ENST00000423557.1 |
| IL10 | CCGGGCAGGTGAAGAATGCCTTTAACTCGAGTTAAAGGCATTCTTCACCTGCTTTTTG | 1548 | chr1 | ENST00000423557.1 |
| IL10 | CCGGGCTGGACAACTTGTTGTTAAACTCGAGTTTAACAACAAGTTGTCCAGCTTTTTG | 1549 | chr1 | ENST00000423557.1 |
| IL10RA | CCGGTCTGTCGCTTCCCGAAGTAACCTCGAGGTTACTTCGGGAAGCGACAGATTTTTG | 1550 | chr11 | ENST00000227752.7 |
| IL10RA | CCGGGAAACAGGATCCTCTAGAATCTCGAGATTTCTAGAGGATCCTGTTTCTTTTTG | 1551 | chr11 | ENST00000227752.7 |
| IL10RA | CCGGGAACTCTTTCCTGTATCATAACTCGAGTTATGATACAGGAAAGAGTTCTTTTTG | 1552 | chr11 | ENST00000227752.7 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| IL11 | CCGGATATCCACTTGAGGGCGATTTCTCGAGAAATCGCCCTCAAGTGGATATTTTTTG | 1553 | chr19 | ENST00000264563.6 |
| IL11 | CCGGCCTTCCAAAGCCAGATCTTATCTCGAGATAAGATCTGGCTTTGGAAGGTTTTTG | 1554 | chr19 | ENST00000264563.6 |
| IL11 | CCGGTGCACAGCTGAGGGACAAATTCTCGAGAATTTGTCCCTCAGCTGTGCATTTTTG | 1555 | chr19 | ENST00000264563.6 |
| IL11RA | CCGGCGGCAGATTCCACCTATAATTCTCGAGAATTATAGGTGGAATCTGCCGTTTTTG | 1556 | chr9 | ENST00000318041.13 |
| IL11RA | CCGGTCGGCAGATTCCACCTATAATCTCGAGATTATAGGTGGAATCTGCCGATTTTTG | 1557 | chr9 | ENST00000318041.13 |
| IL11RA | CCGGTGGAGCCAGTACCGGATTAATCTCGAGATTAATCCGGTACTGGCTCCATTTTTG | 1558 | chr9 | ENST00000318041.13 |
| IL12A | CCGGTGATACCTCTGATCAAGTATTCTCGAGAATACTTGATCAGAGGTATCATTTTTG | 1559 | chr3 | ENST00000305579.6 |
| IL12A | CCGGCCTGTGCCTTAGTAGTATTTACTCGAGTAAATACTACTAAGGCACAGGTTTTTG | 1560 | chr3 | ENST00000305579.6 |
| IL12A | CCGGCCTGTTTACCATTGGAATTAACTCGAGTTAATTCCAATGGTAAACAGGTTTTTG | 1561 | chr3 | ENST00000305579.6 |
| IL12B | CCGGGAATTTGGTCCACTGATATTTCTCGAGAAATATCAGTGGACCAAATTCTTTTTG | 1562 | chr5 | ENST00000231228.2 |
| IL12B | CCGGCCATGGGCCTTCATGCTATTTCTCGAGAAATAGCATGAAGGCCCATGGTTTTTG | 1563 | chr5 | ENST00000231228.2 |
| IL12B | CCGGTTAGATGCTAAATGCTCATTGCTCGAGCAATGAGCATTTAGCATCTAATTTTTG | 1564 | chr5 | ENST00000231228.2 |
| IL12RB1 | CCGGCAGCTCTACAACTCAGTTAAACTCGAGTTTAACTGAGTTGTAGAGCTGTTTTTG | 1565 | chr19 | ENST00000593993.6 |
| IL12RB1 | CCGGGTCATCTCCTCGAACCAATTTCTCGAGAAATTGGTTCGAGGAGATGACTTTTTG | 1566 | chr19 | ENST00000593993.6 |
| IL12RB1 | CCGGCCAACGGGACCACCATGTATTCTCGAGAATACATGGTGGTCCCGTTGGTTTTTG | 1567 | chr19 | ENST00000593993.6 |
| IL13 | CCGGACTTCGAAAGCATCATTATTTCTCGAGAAATAATGATGCTTTCGAAGTTTTTG | 1568 | chr5 | ENST00000304506.7 |
| IL13 | CCGGATTGAAGTTGCAGATTCATTTCTCGAGAAATGAATCTGCAACTTCAATTTTTG | 1569 | chr5 | ENST00000304506.7 |
| IL13 | CCGGCCTGCTCTTACATTTAAAGAACTCGAGTTCTTTAAATGTAAGAGCAGGTTTTTG | 1570 | chr5 | ENST00000304506.7 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| IL15 | CCGGGAAGATCTTATTCAATCTATGCTCGAGCATAGATTGAATAAGATCTTCTTTTTG | 1571 | chr4 | ENST00000296545.11 |
| IL15 | CCGGTAAGGGTGATAGTCAAATTATCTCGAGATAATTTGACTATCACCCTTATTTTTG | 1572 | chr4 | ENST00000296545.11 |
| IL15 | CCGGCACTCTGCTGCTTAGACATAACTCGAGTTATGTCTAAGCAGCAGAGTGTTTTTG | 1573 | chr4 | ENST00000296545.11 |
| IL16 | CCGGTGGGACCACGTGAGATCATTCCTCGAGGAATGATCTCACGTGGTCCCATTTTTG | 1574 | chr15 | ENST00000302987.8 |
| IL16 | CCGGGTTCTGGATGAAGCAACATTACTCGAGTAATGTTGCTTCATCCAGAACTTTTTG | 1575 | chr15 | ENST00000302987.8 |
| IL16 | CCGGCCCAAACAGTGACATTTATTTCTCGAGAAATAAATGTCACTGTTTGGGTTTTTG | 1576 | chr15 | ENST00000302987.8 |
| IL17A | CCGGATCAGTTCTGCCTAGGTAAATCTCGAGATTTACCTAGGCAGAACTGATTTTTTG | 1577 | chr6 | ENST00000340057.1 |
| IL17A | CCGGGAGCTATTTAAGGATCTATTTCTCGAGAAATAGATCCTTAAATAGCTCTTTTTG | 1578 | chr6 | ENST00000340057.1 |
| IL17A | CCGGGGTCAACCTGAACATCCATAACTCGAGTTATGGATGTTCAGGTTGACCTTTTTG | 1579 | chr6 | ENST00000340057.1 |
| IL17B | CCGGTATGCCCGCATGGAGGAGTATCTCGAGATACTCCTCCATGCGGGCATATTTTTG | 1580 | chr5 | ENST00000261796.3 |
| IL17B | CCGGGTGTCACGGATGAAACCGTATCTCGAGATACGGTTTCATCCGTGACACTTTTTG | 1581 | chr5 | ENST00000261796.3 |
| IL17B | CCGGGCAGCTGTGGATGTCCAACAACTCGAGTTGTTGGACATCCACAGCTGCTTTTTG | 1582 | chr5 | ENST00000261796.3 |
| IL17C | CCGGGCACCTCTTCCAGCCCTTAAACTCGAGTTTAAGGGCTGGAAGAGGTGCTTTTTG | 1583 | chr16 | ENST00000244241.4 |
| IL17C | CCGGCTTTGCCTTCCACACCGAGTTCTCGAGAACTCGGTGTGGAAGGCAAAGTTTTTG | 1584 | chr16 | ENST00000244241.4 |
| IL17C | CCGGATCTCCAGCCTCAGTAGTTGGCTCGAGCCAACTACTGAGGCTGGAGATTTTTG | 1585 | chr16 | ENST00000244241.4 |
| IL17D | CCGGAGAGCTACTCTGTTACATTTCCTCGAGGAAATGTAACAGAGTAGCTCTTTTTG | 1586 | chr13 | ENST00000304920.3 |
| IL17D | CCGGCAAAGAGATAGGGACGCATATCTCGAGATATGCGTCCCTATCTCTTTGTTTTTG | 1587 | chr13 | ENST00000304920.3 |
| IL17D | CCGGAGACAGCATCAACTCCAGCATCTCGAGATGCTGGAGTTGATGCTGTCTTTTTTG | 1588 | chr13 | ENST00000304920.3 |

TABLE 15-continued

5' to 3' (Forward) shRNA sequences for Silencing of Cytokine/Chemokine
Genes to Reduce the Incidence of CRS

| Target Gene Symbol | shRNA Forward Oligo Sequence | SEQ ID NO: | Location | Gene ID No. |
|---|---|---|---|---|
| IL17F | CCGGTCATCCACCATGTGCAGT AAGCTCGAGCTTACTGCACATG GTGGATGATTTTTG | 1589 | chr6 | ENST00000336123.4 |
| IL17F | CCGGGTACTTGCTGCTGTCGAT ATTCTCGAGAATATCGACAGCA GCAAGTACTTTTTG | 1590 | chr6 | ENST00000336123.4 |
| IL17F | CCGGCGTTTCCATGTCACGTAA CATCTCGAGATGTTACGTGACA TGGAAACGTTTTTG | 1591 | chr6 | ENST00000336123.4 |
| IL18 | CCGGCCCGGACCATATTTATTA TAACTCGAGTTATAATAAATAT GGTCCGGGTTTTTG | 1592 | chr11 | ENST00000280357.11 |
| IL18 | CCGGTGATTCTGACTGTAGAGA TAACTCGAGTTATCTCTACAGT CAGAATCATTTTTG | 1593 | chr11 | ENST00000280357.11 |
| IL18 | CCGGTGGCAAGCTTGAATCTAA ATTCTCGAGAATTTAGATTCAA GCTTGCCATTTTTG | 1594 | chr11 | ENST00000280357.11 |
| IL18BP | CCGGGGTCCCTTCTCTCACCAA ATTCTCGAGAATTTGGTGAGAG AAGGGACCTTTTTG | 1595 | chr11 | ENST00000260049.9 |
| IL18BP | CCGGTCCCATGTCTCTGCTCATT TACTCGAGTAAATGAGCAGAGA CATGGGATTTTTG | 1596 | chr11 | ENST00000260049.9 |
| IL18BP | CCGGCTGGGCAATGGTTCCTTC ATTCTCGAGAATGAAGGAACCA TTGCCCAGTTTTTG | 1597 | chr11 | ENST00000260049.9 |
| IL19 | CCGGGTCCACGCTGCTGCCATT AAACTCGAGTTTAATGGCAGCA GCGTGGACTTTTTG | 1598 | chr | ENST00000270218.10 |
| IL19 | CCGGTCCACAGACATGCACCAT ATACTCGAGTATATGGTGCATG TCTGTGGATTTTTG | 1599 | chr1 | ENST00000270218.10 |
| IL19 | CCGGTGATGACAAGGAACCTGT ATACTCGAGTATACAGGTTCCT TGTCATCATTTTTG | 1600 | chr1 | ENST00000270218.10 |
| IL1A | CCGGGTGGAACCAACACTAACA TATCTCGAGATATGTTAGTGTT GGTTCCACTTTTTG | 1601 | chr2 | ENST00000263339.3 |
| IL1A | CCGGGCCCTCAATCAAAGTATA ATTCTCGAGAATTATACTTTGAT TGAGGGCTTTTTG | 1602 | chr2 | ENST00000263339.3 |
| IL1A | CCGGTATTACAGATGGGCAAAT TAACTCGAGTTAATTTGCCCAT CTGTAATATTTTTG | 1603 | chr2 | ENST00000263339.3 |
| IL1B | CCGGATCAATAACAAGCTGGAA TTTCTCGAGAAATTCCAGCTTGT TATTGATTTTTG | 1604 | chr2 | ENST00000263341.6 |
| IL1B | CCGGAGCAACCGCTTCCCTATT TATCTCGAGATAAATAGGGAAG CGGTTGCTTTTTG | 1605 | chr2 | ENST00000263341.6 |
| IL1B | CCGGCTGACTTCACCATGCAAT TGCTCGAGCAAATTGCATGGT GAAGTCAGTTTTTG | 1606 | chr2 | ENST00000263341.6 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| IL1F10 | CCGGTCCTTGTGGGCTCAGTTT AATCTCGAGATTAAACTGAGCC CACAAGGATTTTTG | 1607 | chr2 | ENST00000341010.6 |
| IL1F10 | CCGGGGTCTATGGTAGGCAGAA TAACTCGAGTTATTCTGCCTACC ATAGACCTTTTTG | 1608 | chr2 | ENST00000341010.6 |
| IL1F10 | CCGGTGCAGACCAGAAGGCTCT ATACTCGAGTATAGAGCCTTCT GGTCTGCATTTTTG | 1609 | chr2 | ENST00000341010.6 |
| IL1R1 | CCGGGCCAAGAATACACATGGT ATACTCGAGTATACCATGTGTA TTCTTGGCTTTTTG | 1610 | chr2 | ENST00000410023.5 |
| IL1R1 | CCGGATAATGCACAAGCCATAT TTACTCGAGTAAATATGGCTTG TGCATTATTTTTG | 1611 | chr2 | ENST00000410023.5 |
| IL1R1 | CCGGTGGTATAGATGCAGCATA TATCTCGAGATATATGCTGCAT CTATACCATTTTTG | 1612 | chr2 | ENST00000410023.5 |
| IL1R2 | CCGGCAATCCCGTGTAAGGTGT TTCCTCGAGGAAACACCTTACA CGGGATTGTTTTTG | 1613 | chr2 | ENST00000332549.7 |
| IL1R2 | CCGGGACCATTCCTGTGATCAT TTCCTCGAGGAAATGATCACAG GAATGGTCTTTTTG | 1614 | chr2 | ENST00000332549.7 |
| IL1R2 | CCGGCGTTCATCTCATACCCGC AAACTCGAGTTTGCGGGTATGA GATGAACGTTTTTG | 1615 | chr2 | ENST00000332549.7 |
| IL1RAPL1 | CCGGCAAAGCAAGCGGCTGATT ATTCTCGAGAATAATCAGCCGC TTGCTTTGTTTTTG | 1616 | chrX | ENST00000378993.5 |
| IL1RAPL1 | CCGGGCCAGCGTTCTCCTTCAT AAACTCGAGTTTATGAAGGAGA ACGCTGGCTTTTTG | 1617 | chrX | ENST00000378993.5 |
| IL1RAPL1 | CCGGTCAAGCTCCTGACGGTCA TTACTCGAGTAATGACCGTCAG GAGCTTGATTTTTG | 1618 | chrX | ENST00000378993.5 |
| IL1RL1 | CCGGTTACACCGTGGATTGGTA TTACTCGAGTAATACCAATCCA CGGTGTAATTTTTG | 1619 | chr2 | ENST00000233954.5 |
| IL1RL1 | CCGGAGTTGCTGATTCTGGTAT TTACTCGAGTAAATACCAGAAT CAGCAACTTTTTG | 1620 | chr2 | ENST00000233954.5 |
| IL1RL1 | CCGGCGTGAAGGAAGAGGATTT ATTCTCGAGAATAAATCCTCTT CCTTCACGTTTTTG | 1621 | chr2 | ENST00000233954.5 |
| IL1RN | CCGGGCAAGGACCAAATGTCAA TTTCTCGAGAAATTGACATTTG GTCCTTGCTTTTTG | 1622 | chr2 | ENST00000409930.3 |
| IL1RN | CCGGCGTCATGGTCACCAAATT CTACTCGAGTAGAATTTGGTGA CCATGACGTTTTTG | 1623 | chr2 | ENST00000409930.3 |
| IL1RN | CCGGCTGCCTCCAGAATGGTCT TTCCTCGAGGAAAGACCATTCT GGAGGCAGTTTTTG | 1624 | chr2 | ENST00000409930.3 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
| --- | --- | --- | --- | --- |
| IL2 | CCGGGCTACCTATTGTAACTAT TATCTCGAGATAATAGTTACAA TAGGTAGCTTTTTG | 1625 | chr4 | ENST00000226730.4 |
| IL2 | CCGGCAGCTACAACTGGAGCAT TTACTCGAGTAAATGCTCCAGT TGTAGCTGTTTTTG | 1626 | chr4 | ENST00000226730.4 |
| IL2 | CCGGTGCTGGATTTACAGATGA TTTCTCGAGAAATCATCTGTAA ATCCAGCATTTTTG | 1627 | chr4 | ENST00000226730.4 |
| IL20 | CCGGCTGATGCTCTGTGAGATA TTTCTCGAGAAATATCTCACAG AGCATCAGTTTTTG | 1628 | chr1 | ENST00000367096.7 |
| IL20 | CCGGTGGTCACAGTGTATCTTA TTTCTCGAGAAATAAGATACAC TGTGACCATTTTTG | 1629 | chr1 | ENST00000367096.7 |
| IL20 | CCGGGGACTGAAGACACTCAAT TGCTCGAGCAAATTGAGTGTC TTCAGTCCTTTTTG | 1630 | chr1 | ENST00000367096.7 |
| IL20RA | CCGGCCAGTATTATGCCAAAGT TAACTCGAGTTAACTTTGGCAT AATACTGGTTTTTG | 1631 | chr6 | ENST00000316649.9 |
| IL20RA | CCGGGAGGGTCTTCAAGGAGTT AAACTCGAGTTTAACTCCTTGA AGACCCTCTTTTTG | 1632 | chr6 | ENST00000316649.9 |
| IL20RA | CCGGGCTTCGCATTTGATGGAA ATTCTCGAGAATTTCCATCAAA TGCGAAGCTTTTTG | 1633 | chr6 | ENST00000316649.9 |
| IL20RB | CCGGCAGTGTACTATTCTGTCG AATCTCGAGATTCGACAGAATA GTACACTGTTTTTG | 1634 | chr3 | ENST00000329582.8 |
| IL20RB | CCGGCCAGAATAATCCTTGAGA GAACTCGAGTTCTCTCAAGGAT TATTCTGGTTTTTG | 1635 | chr3 | ENST00000329582.8 |
| IL20RB | CCGGCTCTGTACTCTCAACCAA CATCTCGAGATGTTGGTTGAGA GTACAGAGTTTTTG | 1636 | chr3 | ENST00000329582.8 |
| IL21 | CCGGAGGAAACCACCTTCCACA AATCTCGAGATTTGTGGAAGGT GGTTTCCTTTTTG | 1637 | chr4 | ENST00000264497.7 |
| IL21 | CCGGATGACTTGGTCCCTGAAT TCCTCGAGGAAATTCAGGGAC CAAGTCATTTTTG | 1638 | chr4 | ENST00000264497.7 |
| IL21 | CCGGCTTTCAGAAGGCCCAACT AAACTCGAGTTTAGTTGGGCCT TCTGAAAGTTTTTG | 1639 | chr4 | ENST00000264497.7 |
| IL22 | CCGGAGGCTAAGCACATGTCAT ATTCTCGAGAATATGACATGTG CTTAGCCTTTTTG | 1640 | chr12 | ENST00000328087.5 |
| IL22 | CCGGGTTTCCATAATCAGTACT TTACTCGAGTAAAGTACTGATT ATGGAAACTTTTTG | 1641 | chr12 | ENST00000328087.5 |
| IL22 | CCGGAGACTTTCTAAGCATAGA TATCTCGAGATATCTATGCTTA GAAAGTCTTTTTTG | 1642 | chr12 | ENST00000328087.5 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| IL22RA1 | CCGGGGACACTTTCTAGTCCTAAACCTCGAGGTTTAGGACTAGAAAGTGTCCTTTTTG | 1643 | chr1 | ENST00000270800.1 |
| IL22RA1 | CCGGAGGGACACCACAGTACCTAAACTCGAGTTTAGGTACTGTGGTGTCCCTTTTTG | 1644 | chr1 | ENST00000270800.1 |
| IL22RA1 | CCGGCTGTCCGAGATCACCTACTTACTCGAGTAAGTAGGTGATCTCGGACAGTTTTTG | 1645 | chr1 | ENST00000270800.1 |
| IL22RA2 | CCGGAGACATACAGGAACCTTATTACTCGAGTAATAAGGTTCCTGTATGTCTTTTTG | 1646 | chr6 | ENST00000349184.8 |
| IL22RA2 | CCGGCTCGTGTTTGAAGGATCTTATCTCGAGATAAGATCCTTCAAACACGAGTTTTTG | 1647 | chr6 | ENST00000349184.8 |
| IL22RA2 | CCGGTGCTCCAAATTTACCATATAGCTCGAGCTATATGGTAAATTTGGAGCATTTTTG | 1648 | chr6 | ENST00000349184.8 |
| IL23A | CCGGAGCTGCTAGGATCGGATATTTCTCGAGAAATATCCGATCCTAGCAGCTTTTTG | 1649 | chr12 | ENST00000228534.5 |
| IL23A | CCGGCTGTGAGCCAACAGGTTAATTCTCGAGAATTAACCTGTTGGCTCACAGTTTTTG | 1650 | chr12 | ENST00000228534.5 |
| IL23A | CCGGGGATCCACCAGGGTCTGATTTCTCGAGAAATCAGACCCTGGTGGATCCTTTTTG | 1651 | chr12 | ENST00000228534.5 |
| IL23R | CCGGCTTTCTTTGATTGGGATATTTCTCGAGAAATATCCCAATCAAAGAAAGTTTTTG | 1652 | chr1 | ENST00000347310.9 |
| IL23R | CCGGTATCTCACCTCAAGCTATATTCTCGAGAATATAGCTTGAGGTGAGATATTTTTG | 1653 | chr1 | ENST00000347310.9 |
| IL23R | CCGGCGACAATACTACAGTTGTATACTCGAGTATACAACTGTAGTATTGTCGTTTTTG | 1654 | chr1 | ENST00000347310.9 |
| IL24 | CCGGCACAGGCGGTTTCTGCTATTCCTCGAGGAATAGCAGAAACCGCCTGTGTTTTTG | 1655 | chr1 | ENST00000294984.6 |
| IL24 | CCGGGTCAGGACTCTGAAGTCATTCCTCGAGGAATGACTTCAGAGTCCTGACTTTTTG | 1656 | chr1 | ENST00000294984.6 |
| IL24 | CCGGTCGGATGCTGAGAGCTGTTACCTCGAGGTAACAGCTCTCAGCATCCGATTTTTG | 1657 | chr1 | ENST00000294984.6 |
| IL25 | CCGGACAGGCACTTTCTAGATATTTCTCGAGAAATATCTAGAAAGTGCCTGTTTTTG | 1658 | chr14 | ENST00000329715.2 |
| IL25 | CCGGCCACAACCAGACTGTCTTCTACTCGAGTAGAAGACAGTCTGGTTGTGGTTTTTG | 1659 | chr14 | ENST00000329715.2 |
| IL25 | CCGGTCCTGTAGGGCCAGTGAAGATCTCGAGATCTTCACTGGCCCTACAGGATTTTTG | 1660 | chr14 | ENST00000329715.2 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| IL26 | CCGGAGCTGTTGACGCTCTCTATATCTCGAGATATAGAGAGCGTCAACAGCTTTTTG | 1661 | chr12 | ENST00000229134.4 |
| IL26 | CCGGAGTACATTGTGTCAACTTAATCTCGAGATTAAGTTGACACAATGTACTTTTTG | 1662 | chr12 | ENST00000229134.4 |
| IL26 | CCGGCGATTCCAGAAGACCGCATAACTCGAGTTATGCGGTCTTCTGGAATCGTTTTTG | 1663 | chr12 | ENST00000229134.4 |
| IL27 | CCGGACTCCTTGGAGCTCGTCTTATCTCGAGATAAGACGAGCTCCAAGGAGTTTTTG | 1664 | chr16 | ENST00000356897.1 |
| IL27 | CCGGACTTTAGGACTGGAGTCTTGGCTCGAGCCAAGACTCCAGTCCTAAAGTTTTTG | 1665 | chr16 | ENST00000356897.1 |
| IL27 | CCGGCATCATCAGCCTTGGACAAGGCTCGAGCCTTGTCCAAGGCTGATGATGTTTTTG | 1666 | chr16 | ENST00000356897.1 |
| IL2RA | CCGGCCTCGTCACAACAACAGATTTCTCGAGAAATCTGTTGTTGTGACGAGGTTTTTG | 1667 | chr10 | ENST00000379959.7 |
| IL2RA | CCGGACCCTATACAACTGGACATTGCTCGAGCAATGTCCAGTTGTATAGGGTTTTTG | 1668 | chr10 | ENST00000379959.7 |
| IL2RA | CCGGACTCGGAACACAACGAAACAACTCGAGTTGTTTCGTTGTGTTCCGAGTTTTTG | 1669 | chr10 | ENST00000379959.7 |
| IL2RB | CCGGAGTCCCAGACCTGGTGGATTTCTCGAGAAATCCACCAGGTCTGGGACTTTTTG | 1670 | chr22 | ENST00000216223.9 |
| IL2RB | CCGGGACCCACAGATGCAACATAAGCTCGAGCTTATGTTGCATCTGTGGGTCTTTTTG | 1671 | chr22 | ENST00000216223.9 |
| IL2RB | CCGGCCAGACACCCAGTATGAGTTTCTCGAGAAACTCATACTGGGTGTCTGGTTTTTG | 1672 | chr22 | ENST00000216223.9 |
| IL2RG | CCGGTCGTGTTCGGAGCCGCTTTAACTCGAGTTAAAGCGGCTCCGAACACGATTTTTG | 1673 | chrX | ENST00000374202.6 |
| IL2RG | CCGGCCAACCTCACTCTGCATTATTCTCGAGAATAATGCAGAGTGAGGTTGGTTTTTG | 1674 | chrX | ENST00000374202.6 |
| IL2RG | CCGGTTGGCTCCATGGGATTGATTACTCGAGTAATCAATCCCATGGAGCCAATTTTTG | 1675 | chrX | ENST00000374202.6 |
| IL3 | CCGGTTATCCCATTGAGACTATTTACTCGAGTAAATAGTCTCAATGGGATAATTTTTG | 1676 | chr5 | ENST00000296870.2 |
| IL3 | CCGGCGGCATCAGATGAATTGTTAACTCGAGTTAACAATTCATCTGATGCCGTTTTTG | 1677 | chr5 | ENST00000296870.2 |
| IL3 | CCGGGCAATTGAGAGCATTCTTAAACTCGAGTTTAAGAATGCTCTCAATTGCTTTTTG | 1678 | chr5 | ENST00000296870.2 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| IL31 | CCGGGCATATCTCAAGACAATCAGACTCGAGTCTGATTGTCTTGAGATATGCTTTTTG | 1679 | chr12 | ENST00000377035.1 |
| IL31 | CCGGCCAAGTGATGATGTACAGAAACTCGAGTTTCTGTACATCATCACTTGGTTTTTG | 1680 | chr12 | ENST00000377035.1 |
| IL31 | CCGGCCTGACTATTTCTCAACAGTTCTCGAGAACTGTTGAGAAATAGTCAGGTTTTTG | 1681 | chr12 | ENST00000377035.1 |
| IL31RA | CCGGCATCAAACGAATGATTCAAATCTCGAGATTTGAATCATTCGTTTGATGTTTTTG | 1682 | chr5 | ENST00000447346.6 |
| IL31RA | CCGGCGCCTGTTTCATCTGATTTAACTCGAGTTAAATCAGATGAAACAGGCGTTTTTG | 1683 | chr5 | ENST00000447346.6 |
| IL31RA | CCGGTTTCCTGTGTCTACTACTATACTCGAGTATAGTAGTAGACACAGGAAATTTTTG | 1684 | chr5 | ENST00000447346.6 |
| IL32 | CCGGTGTCGCCCTGGCATCTTAATACTCGAGTATTAAGATGCCAGGGCGACATTTTTG | 1685 | chr16 | ENST00000325568.9 |
| IL32 | CCGGAGAGCTCACTCCTCTACTTGACTCGAGTCAAGTAGAGGAGTGAGCTCTTTTTG | 1686 | chr16 | ENST00000325568.9 |
| IL32 | CCGGAGAGCTGGAGGACGACTTCAACTCGAGTTGAAGTCGTCCTCCAGCTCTTTTTG | 1687 | chr16 | ENST00000325568.9 |
| IL33 | CCGGGAGTGCTTTGCCTTTGGTATACTCGAGTATACCAAAGGCAAAGCACTCTTTTTG | 1688 | chr9 | ENST00000381434.7 |
| IL33 | CCGGGCACTCCAACTGTGTTTCATTCTCGAGAATGAAACACAGTTGGAGTGCTTTTTG | 1689 | chr9 | ENST00000381434.7 |
| IL33 | CCGGCCTGTTACTTTAGGAGAGAAACTCGAGTTTCTCTCCTAAAGTAACAGGTTTTTG | 1690 | chr9 | ENST00000381434.7 |
| IL34 | CCGGGCCGACTTCAGTACATGAAACCTCGAGGTTTCATGTACTGAAGTCGGCTTTTTG | 1691 | chr16 | ENST00000288098.6 |
| IL34 | CCGGCAGAGCCCTCATTGCAGTATGCTCGAGCATACTGCAATGAGGGCTCTGTTTTTG | 1692 | chr16 | ENST00000288098.6 |
| IL34 | CCGGCCGTGTTGTCCCTCTTGAATGCTCGAGCATTCAAGAGGGACAACACGGTTTTTG | 1693 | chr16 | ENST00000288098.6 |
| IL36A | CCGGCTCCAGTCACTATTGCCTTAACTCGAGTTAAGGCAATAGTGACTGGAGTTTTTG | 1694 | chr2 | ENST00000259211.6 |
| IL36A | CCGGTTCAGGACCAGACGCTCATAGCTCGAGCTATGAGCGTCTGGTCCTGAATTTTTG | 1695 | chr2 | ENST00000259211.6 |
| IL36A | CCGGCTCTGCCTGATGTGTGCTAAACTCGAGTTTAGCACACATCAGGCAGAGTTTTTG | 1696 | chr2 | ENST00000259211.6 |

TABLE 15-continued

5' to 3' (Forward) shRNA sequences for Silencing of Cytokine/Chemokine
Genes to Reduce the Incidence of CRS

| Target Gene Symbol | shRNA Forward Oligo Sequence | SEQ ID NO: | Location | Gene ID No. |
|---|---|---|---|---|
| IL36B | CCGGATCCTATGCTATTCGTGATTCCTCGAGGAATCACGAATAGCATAGGATTTTTTG | 1697 | chr2 | ENST00000327407.2 |
| IL36B | CCGGCCTGAGTGGAAATTCTTTAATCTCGAGATTAAAGAATTTCCACTCAGGTTTTTG | 1698 | chr2 | ENST00000327407.2 |
| IL36B | CCGGTTGGACTACATAACCTGTAAACTCGAGTTTACAGGTTATGTAGTCCAATTTTTG | 1699 | chr2 | ENST00000327407.2 |
| IL36G | CCGGTGATATCATCCAGTCTTTATACTCGAGTATAAAGACTGGATGATATCATTTTTG | 1700 | chr2 | ENST00000259205.4 |
| IL36G | CCGGCAGGAGAGCTGGGTGGTATAACTCGAGTTATACCACCCAGCTCTCCTGTTTTTG | 1701 | chr2 | ENST00000259205.4 |
| IL36G | CCGGGGGAATCCAGAATCCAGAAATCTCGAGATTTCTGGATTCTGGATTCCCTTTTTG | 1702 | chr2 | ENST00000259205.4 |
| IL36RN | CCGGCTCGGCATTGAAGGTGCTTTACTCGAGTAAAGCACCTTCAATGCCGAGTTTTTG | 1703 | chr2 | ENST00000346807.7 |
| IL36RN | CCGGTGGTTCCCAGTTTGGATAAATCTCGAGATTTATCCAAACTGGGAACCATTTTTG | 1704 | chr2 | ENST00000346807.7 |
| IL36RN | CCGGGGGAATCATTCCTGCTTAATGCTCGAGCATTAAGCAGGAATGATTCCCTTTTTG | 1705 | chr2 | ENST00000346807.7 |
| IL37 | CCGGCTCTACTGTGACAAGGATAAACTCGAGTTTATCCTTGTCACAGTAGAGTTTTTG | 1706 | chr2 | ENST00000263326.7 |
| IL37 | CCGGTGCACCTCCTGCAATTGTAATCTCGAGATTACAATTGCAGGAGGTGCATTTTTG | 1707 | chr2 | ENST00000263326.7 |
| IL37 | CCGGGTTCACACAAAGATCTTCTTTCTCGAGAAAGAAGATCTTTGTGTGAACTTTTTG | 1708 | chr2 | ENST00000263326.7 |
| IL4 | CCGGAGCTGATCCGATTCCTGAAACCTCGAGGTTTCAGGAATCGGATCAGCTTTTTG | 1709 | chr5 | ENST00000231449.6 |
| IL4 | CCGGCCACGGACACAAGTGCGATATCTCGAGATATCGCACTTGTGTCCGTGGTTTTTG | 1710 | chr5 | ENST00000231449.6 |
| IL4 | CCGGTAGCATGTGCCGGCAACTTGCTCGAGCAAAGTTGCCGGCACATGCTATTTTTG | 1711 | chr5 | ENST00000231449.6 |
| IL5 | CCGGGCAAGAGTTTCTTGGTGTAATCTCGAGATTACACCAAGAAACTCTTGCTTTTTG | 1712 | chr5 | ENST00000231454.5 |
| IL5 | CCGGGGGTACTGTGGAAAGACTATTCTCGAGAATAGTCTTTCCACAGTACCCTTTTTG | 1713 | chr5 | ENST00000231454.5 |
| IL5 | CCGGGAAAGAGTCAGGCCTTAATTTCTCGAGAAATTAAGGCCTGACTCTTTCTTTTTG | 1714 | chr5 | ENST00000231454.5 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| IL6 | CCGGATGAGCGTTAGGACACTA TTTCTCGAGAAATAGTGTCCTA ACGCTCATTTTTTG | 1715 | chr7 | ENST00000258743.9 |
| IL6 | CCGGGAGTACCTCCAGAACAGA TTTCTCGAGAAATCTGTTCTGG AGGTACTCTTTTTG | 1716 | chr7 | ENST00000258743.9 |
| IL6 | CCGGATGTGAAGCTGAGTTAAT TTACTCGAGTAAATTAACTCAG CTTCACATTTTTTG | 1717 | chr7 | ENST00000258743.9 |
| IL6R | CCGGGCAGGCACTTACTACTAA TAACTCGAGTTATTAGTAGTAA GTGCCTGCTTTTTG | 1718 | chr1 | ENST00000368485.7 |
| IL6R | CCGGTATCGGGCTGAACGGTCA AAGCTCGAGCTTTGACCGTTCA GCCCGATATTTTTG | 1719 | chr1 | ENST00000368485.7 |
| IL6R | CCGGCTGGACCCTGTGGATGAT AAACTCGAGTTTATCATCCACA GGGTCCAGTTTTTG | 1720 | chr1 | ENST00000368485.7 |
| IL6ST | CCGGACCGTGCATCGCACCTAT TTACTCGAGTAAATAGGTGCGA TGCACGGTTTTTG | 1721 | chr5 | ENST00000336909.9 |
| IL6ST | CCGGACTTCAGCAGTACCTATA AAGCTCGAGCTTTATAGGTACT GCTGAAGTTTTTG | 1722 | chr5 | ENST00000336909.9 |
| IL6ST | CCGGCGGCCAGAAGATCTACAA TTACTCGAGTAATTGTAGATCTT CTGGCCGTTTTTG | 1723 | chr5 | ENST00000336909.9 |
| IL7 | CCGGGCTCGCAAGTTGAGGCAA TTTCTCGAGAAATTGCCTCAAC TTGCGAGCTTTTTG | 1724 | chr8 | ENST00000263851.8 |
| IL7 | CCGGGCTCACTATGAATCTATT ATACTCGAGTATAATAGATTCA TAGTGAGCTTTTTG | 1725 | chr8 | ENST00000263851.8 |
| IL7 | CCGGGTGTTTCCTAAAGAGACT ATTCTCGAGAATAGTCTCTTTA GGAAACACTTTTTG | 1726 | chr8 | ENST00000263851.8 |
| IL9 | CCGGACCACCATGCAAACAAGA TACCTCGAGGTATCTTGTTTGCA TGGTGGTTTTTTG | 1727 | chr5 | ENST00000274520.1 |
| IL9 | CCGGGAACAACAAGTGTCCATA TTTCTCGAGAAATATGGACACT TGTTGTTCTTTTTG | 1728 | chr5 | ENST00000274520.1 |
| IL9 | CCGGCTGAAGAGTCTTCTGGAA ATTCTCGAGAATTTCCAGAAGA CTCTTCAGTTTTTG | 1729 | chr5 | ENST00000274520.1 |
| INHA | CCGGCCTCGGATGGAGGTTACT CTTCTCGAGAAGAGTAACCTCC ATCCGAGGTTTTTG | 1730 | chr2 | ENST00000243786.2 |
| INHA | CCGGGCAGCACTGTGCTTGTAT CTACTCGAGTAGATACAAGCAC AGTGCTGCTTTTTG | 1731 | chr2 | ENST00000243786.2 |
| INHA | CCGGTGGAGGTTACTCTTTCAA GTACTCGAGTACTTGAAAGAGT AACCTCCATTTTTG | 1732 | chr2 | ENST00000243786.2 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| INHBA | CCGGAGGCACTTTCCTACCCAA TTACTCGAGTAATTGGGTAGGA AAGTGCCTTTTTG | 1733 | chr7 | ENST00000242208.4 |
| INHBA | CCGGGAGAATGGTGTACCCTTT ATTCTCGAGAATAAAGGGTACA CCATTCTCTTTTTG | 1734 | chr7 | ENST00000242208.4 |
| INHBA | CCGGAGACGCTGCACTTCGAGA TTTCTCGAGAAATCTCGAAGTG CAGCGTCTTTTTG | 1735 | chr7 | ENST00000242208.4 |
| INHBB | CCGGCAAATGGATGCGGTGACA AATCTCGAGATTTGTCACCGCA TCCATTTGTTTTTG | 1736 | chr2 | ENST00000295228.3 |
| INHBB | CCGGGCTGGAACGACTGGATCA TAGCTCGAGCTATGATCCAGTC GTTCCAGCTTTTTG | 1737 | chr2 | ENST00000295228.3 |
| INHBB | CCGGTGATGAGTACAACATCGT CAACTCGAGTTGACGATGTTGT ACTCATCATTTTTG | 1738 | chr2 | ENST00000295228.3 |
| INHBC | CCGGTCAACCAGACTCGTCTTG ATTCTCGAGAATCAAGACGAGT CTGGTTGATTTTTG | 1739 | chr12 | ENST00000309668.2 |
| INHBC | CCGGCAAGACTGACATACCTGA CATCTCGAGATGTCAGGTATGT CAGTCTTGTTTTTG | 1740 | chr12 | ENST00000309668.2 |
| INHBC | CCGGCAGGCCAGTCTCATGTTC TTTCTCGAGAAAGAACATGAGA CTGGCCTGTTTTTG | 1741 | chr12 | ENST00000309668.2 |
| INHBE | CCGGCTCCTCTACCTGGATCAT AATCTCGAGATTATGATCCAGG TAGAGGAGTTTTTG | 1742 | chr12 | ENST00000266646.2 |
| INHBE | CCGGACCTGGGCTGGCATACCT TAACTCGAGTTAAGGTATGCCA GCCCAGGTTTTTG | 1743 | chr12 | ENST00000266646.2 |
| INHBE | CCGGGCAGCCCTTCCTAGAGCT TAACTCGAGTTAAGCTCTAGGA AGGGCTGCTTTTTG | 1744 | chr12 | ENST00000266646.2 |
| ITGA4 | CCGGCCAACGCTTCAGTGATCA ATCCTCGAGGATTGATCACTGA AGCGTTGGTTTTTG | 1745 | chr2 | ENST00000397033.6 |
| ITGA4 | CCGGTGTAGAACACATCAAGCA TTTCTCGAGAAATGCTTGATGT GTTCTACATTTTTG | 1746 | chr2 | ENST00000397033.6 |
| ITGA4 | CCGGCATGATCTTGTGACATAT TATCTCGAGATAATATGTCACA AGATCATGTTTTTG | 1747 | chr2 | ENST00000397033.6 |
| ITGAV | CCGGTTGAAGTGTACCCTAGCA TTTCTCGAGAAATGCTAGGGTA CACTTCAATTTTTG | 1748 | chr2 | ENST00000261023.7 |
| ITGAV | CCGGCACTCCAAGAACATGACT ATTCTCGAGAATAGTCATGTTC TTGGAGTGTTTTTG | 1749 | chr2 | ENST00000261023.7 |
| ITGAV | CCGGGTGAGGTCGAAACAGGAT AAACTCGAGTTTATCCTGTTTCG ACCTCACTTTTTG | 1750 | chr2 | ENST00000261023.7 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
| --- | --- | --- | --- | --- |
| ITGB1 | CCGGTTTGTAGGAAGAGGGATAATACTCGAGTATTATCCCTCTTCCTACAAATTTTTG | 1751 | chr10 | ENST00000302278.7 |
| ITGB1 | CCGGGCCTTGCATTACTGCTGATATCTCGAGATATCAGCAGTAATGCAAGGCTTTTTG | 1752 | chr10 | ENST00000302278.7 |
| ITGB1 | CCGGGCCTTGCATTACTGCTGATATCTCGAGATATCAGCAGTAATGCAAGGCTTTTTG | 1753 | chr10 | ENST00000302278.7 |
| ITGB3 | CCGGGTCGTCAGATTCCAGTACTATCTCGAGATAGTACTGGAATCTGACGACTTTTTG | 1754 | chr17 | ENST00000559488.5 |
| ITGB3 | CCGGGTCGTCAGATTCCAGTACTATCTCGAGATAGTACTGGAATCTGACGACTTTTTG | 1755 | chr17 | ENST00000559488.5 |
| ITGB3 | CCGGCCACGTCTACCTTCACCAATACTCGAGTATTGGTGAAGGTAGACGTGGTTTTTG | 1756 | chr17 | ENST00000559488.5 |
| KIT | CCGGACTTCATCTAACGAGATTAAACTCGAGTTTAATCTCGTTAGATGAAGTTTTTG | 1757 | chr4 | ENST00000288135.5 |
| KIT | CCGGGCGACGAGATTAGGCTGTTATCTCGAGATAACAGCCTAATCTCGTCGCTTTTTG | 1758 | chr4 | ENST00000288135.5 |
| KIT | CCGGACGAGTTGGCCCTAGACTTAGCTCGAGCTAAGTCTAGGGCCAACTCGTTTTTG | 1759 | chr4 | ENST00000288135.5 |
| KITLG | CCGGGCAGGAATCGTGTGACTAATACTCGAGTATTAGTCACACGATTCCTGCTTTTTG | 1760 | chr12 | ENST00000228280.9 |
| KITLG | CCGGGCAGGAATCGTGTGACTAATACTCGAGTATTAGTCACACGATTCCTGCTTTTTG | 1761 | chr12 | ENST00000228280.9 |
| KITLG | CCGGCCTATTTAATCCTCTCGTCAACTCGAGTTGACGAGAGGATTAAATAGGTTTTTG | 1762 | chr12 | ENST00000228280.9 |
| KLHL20 | CCGGGCCAATACATGGAGGTTATATCTCGAGATATAACCTCCATGTATTGGCTTTTTG | 1763 | chr1 | ENST00000209884.4 |
| KLHL20 | CCGGGCCGCAAGAACGACCACTAATCTCGAGATTAGTGGTCGTTCTTGCGGCTTTTTG | 1764 | chr1 | ENST00000209884.4 |
| KLHL20 | CCGGCACATTGTGAATCCCATATTTCTCGAGAAATATGGGATTCACAATGTGTTTTTG | 1765 | chr1 | ENST00000209884.4 |
| LEFTY1 | CCGGACAAGTTACCTCACCTAATTTCTCGAGAAATTAGGTGAGGTAACTTGTTTTTG | 1766 | chr1 | ENST00000272134.5 |
| LEFTY1 | CCGGAGCCCAATGTGTCATTGTTTACTCGAGTAAACAATGACACATTGGGCTTTTTG | 1767 | chr1 | ENST00000272134.5 |
| LEFTY1 | CCGGTCTCTAGTGAGCCCTGAATTTCTCGAGAAATTCAGGGCTCACTAGAGATTTTTG | 1768 | chr1 | ENST00000272134.5 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
| --- | --- | --- | --- | --- |
| LEFTY2 | CCGGAGTTACTCCATCCCAATTTAGCTCGAGCTAAATTGGGATGGAGTAACTTTTTG | 1769 | chr1 | ENST00000366820.9 |
| LEFTY2 | CCGGCTAAGCACTTACGTGAGTAAACTCGAGTTTACTCACGTAAGTGCTTAGTTTTTG | 1770 | chr1 | ENST00000366820.9 |
| LEFTY2 | CCGGTAGGCGCCTGGTGTATCCATTCTCGAGAATGGATACACCAGGCGCCTATTTTTG | 1771 | chr1 | ENST00000366820.9 |
| LIF | CCGGGCAGTGCCAATGCCCTCTTTACTCGAGTAAAGAGGGCATTGGCACTGCTTTTTG | 1772 | chr22 | ENST00000249075.3 |
| LIF | CCGGACCGCATAGTCGTGTACCTTGCTCGAGCAAGGTACACGACTATGCGGTTTTTG | 1773 | chr22 | ENST00000249075.3 |
| LIF | CCGGCAACAACCTGGACAAGCTATGCTCGAGCATAGCTTGTCCAGGTTGTTGTTTTTG | 1774 | chr22 | ENST00000249075.3 |
| LIFR | CCGGTGACTTGCGACTACGTCATTACTCGAGTAATGACGTAGTCGCAAGTCATTTTTG | 1775 | chr5 | ENST00000263409.8 |
| LIFR | CCGGACTTCTGCAGATTCGATATTACTCGAGTAATATCGAATCTGCAGAAGTTTTTG | 1776 | chr5 | ENST00000263409.8 |
| LIFR | CCGGGTAGGCTCAGACATAACATTTCTCGAGAAATGTTATGTCTGAGCCTACTTTTTG | 1777 | chr5 | ENST00000263409.8 |
| LTA | CCGGGCCCTAGTACTGTCTTCTTTGCTCGAGCAAAGAAGACAGTACTAGGGCTTTTTG | 1778 | chr6 | ENST00000418386.2 |
| LTA | CCGGGATCAAGTCACCGGAGCTTCCTCGAGGAAAGCTCCGGTGACTTGATCTTTTTG | 1779 | chr6 | ENST00000418386.2 |
| LTA | CCGGGCTCCCAGAAGATGGTGTATCCTCGAGGATACACCATCTTCTGGGAGCTTTTTG | 1780 | chr6 | ENST00000418386.2 |
| LTB | CCGGGCGAGAGGGAAGACCTTCTTTCTCGAGAAAGAAGGTCTTCCCTCTCGCTTTTTG | 1781 | chr6 | ENST00000429299.2 |
| LTB | CCGGCGAGAGGGTGTACGTCAACATCTCGAGATGTTGACGTACACCCTCTCGTTTTTG | 1782 | chr6 | ENST00000429299.2 |
| LTB | CCGGGACGAAGGAACAGGCGTTTCTCTCGAGAGAAACGCCTGTTCCTTCGTCTTTTTG | 1783 | chr6 | ENST00000429299.2 |
| LTBP1 | CCGGGATGACCTGTGTCGATGTAAACTCGAGTTTACATCGACACAGGTCATCTTTTTG | 1784 | chr2 | ENST00000407925.5 |
| LTBP1 | CCGGGGTGGAACAGTGCTGTTATTTCTCGAGAAATAACAGCACTGTTCCACCTTTTTG | 1785 | chr2 | ENST00000407925.5 |
| LTBP1 | CCGGCCGTTGAATACCGCCTTGAATCTCGAGATTCAAGGCGGTATTCAACGGTTTTTG | 1786 | chr2 | ENST00000407925.5 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| LTBP3 | CCGGGCATCCTCAATGGATGTGAAACTCGAGTTTCACATCCATTGAGGATGCTTTTTG | 1787 | chr11 | ENST00000322147.8 |
| LTBP3 | CCGGTGTTGTTCGGGTCGGAGATTTCTCGAGAAATCTCCGACCCGAACAACATTTTTG | 1788 | chr11 | ENST00000322147.8 |
| LTBP3 | CCGGAGCGCTTCAAGGTGGTCTTTGCTCGAGCAAAGACCACCTTGAAGCGCTTTTTG | 1789 | chr11 | ENST00000322147.8 |
| LTBP4 | CCGGGCTTCGACATGCCAGACTTTGCTCGAGCAAAGTCTGGCATGTCGAAGCTTTTTG | 1790 | chr19 | ENST00000308370.11 |
| LTBP4 | CCGGTGAAACACTACAGGGTGTATGCTCGAGCATACACCCTGTAGTGTTTCATTTTTG | 1791 | chr19 | ENST00000308370.11 |
| LTBP4 | CCGGCAACCGGCTTTGAAAGAGTTACTCGAGTAACTCTTTCAAAGCCGGTTGTTTTG | 1792 | chr19 | ENST00000308370.11 |
| MAF | CCGGTCAGTGGGATACGCCACATTTCTCGAGAAATGTGGCGTATCCCACTGATTTTTG | 1793 | chr16 | ENST00000326043.4 |
| MAF | CCGGTTTATGGTGTGTGCAAGTAAACTCGAGTTTACTTGCACACACCATAAATTTTTG | 1794 | chr16 | ENST00000326043.4 |
| MAF | CCGGGTTAGAGAAGAAGGCTATTAACTCGAGTTAATAGCCTTCTTCTCTAACTTTTTG | 1795 | chr16 | ENST00000326043.4 |
| MAF | CCGGTGTTAATGACTTCGATCTGATCTCGAGATCAGATCGAAGTCATTAACATTTTTG | 1796 | chr16 | ENST00000326043.4 |
| MIF | CCGGCTACATCAACTATTACGACATCTCGAGATGTCGTAATAGTTGATGTAGTTTTTG | 1797 | chr22 | ENST00000215754.7 |
| MIF | CCGGCTACATCAACTATTACGACATCTCGAGATGTCGTAATAGTTGATGTAGTTTTTG | 1798 | chr22 | ENST00000215754.7 |
| MIF | CCGGGACAGGGTCTACATCAACTATCTCGAGATAGTTGATGTAGACCCTGTCTTTTTG | 1799 | chr22 | ENST00000215754.7 |
| MINOS1- | CCGGGCCAAGCTGCACAATTTAATACTCGAGTATTAAATTGTGCAGCTTGGCTTTTTG | 1800 | chr1 | ENST00000602662.1 |
| MINOS1- | CCGGGCTGGCACTGTTCCCAGATAACTCGAGTTATCTGGGAACAGTGCCAGCTTTTTG | 1801 | chr1 | ENST00000602662.1 |
| MINOS1- | CCGGAGAAAGACCACTGGCAGAAACCTCGAGGTTTCTGCCAGTGGTCTTTCTTTTTTG | 1802 | chr | ENST00000602662.1 |
| MSTN | CCGGAGGCCCAACTATGGATATATTCTCGAGAATATATCCATAGTTGGGCCTTTTTG | 1803 | chr2 | ENST00000260950.4 |
| MSTN | CCGGGAGCTAGAAGGAGATCAAATTCTCGAGAATTTGATCTCCTTCTAGCTCTTTTTG | 1804 | chr2 | ENST00000260950.4 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| MSTN | CCGGGTATGCTTTAAAGTCTATTTCCTCGAGGAAATAGACTTTAAAGCATACTTTTTG | 1805 | chr2 | ENST00000260950.4 |
| NAMPT | CCGGAGCGATAGCTATGACATTTATCTCGAGATAAATGTCATAGCTATCGCTTTTTG | 1806 | chr7 | ENST00000222553.7 |
| NAMPT | CCGGGTGAAGATCTAAGACATTTAACTCGAGTTAAATGTCTTAGATCTTCACTTTTTG | 1807 | chr7 | ENST00000222553.7 |
| NAMPT | CCGGTACAAGGTTACTCACTATAAACTCGAGTTTATAGTGAGTAACCTTGTATTTTTG | 1808 | chr7 | ENST00000222553.7 |
| NBL1 | CCGGGCCAAGCTGCACAATTTAATACTCGAGTATTAAATTGTGCAGCTTGGCTTTTTG | 1809 | chr1 | ENST00000375136.7 |
| NBL1 | CCGGGCTGGCACTGTTCCCAGATAACTCGAGTTATCTGGGAACAGTGCCAGCTTTTTG | 1810 | chr1 | ENST00000375136.7 |
| NBL1 | CCGGAGAAAGACCACTGGCAGAAACCTCGAGGTTTCTGCCAGTGGTCTTTCTTTTTG | 1811 | chr1 | ENST00000375136.7 |
| NDP | CCGGCTGCTAAAGGTTACCGATTTCCTCGAGGAAATCGGTAACCTTTAGCAGTTTTTG | 1812 | chrX | ENST00000378062.5 |
| NDP | CCGGCTCTGCATATTCTAGTAATAACTCGAGTTATTACTAGAATATGCAGAGTTTTTG | 1813 | chrX | ENST00000378062.5 |
| NDP | CCGGACGGACAGCTCATTCATAATGCTCGAGCATTATGAATGAGCTGTCCGTTTTTG | 1814 | chrX | ENST00000378062.5 |
| NLRP7 | CCGGCCGTTCAAGGAAATTTCTATTCTCGAGAATAGAAATTTCCTTGAACGGTTTTTG | 1815 | chr19 | ENST00000328092.9 |
| NLRP7 | CCGGCGGGTCTCTAAGATGTCTTATCTCGAGATAAGACATCTTAGAGACCCGTTTTTG | 1816 | chr19 | ENST00000328092.9 |
| NLRP7 | CCGGACCTGCTCAGAAATCATAAATCTCGAGATTTATGATTTCTGAGCAGGTTTTTG | 1817 | chr19 | ENST00000328092.9 |
| NODAL | CCGGGTGCTCCTAGATCACCATAAACTCGAGTTTATGGTGATCTAGGAGCACTTTTTG | 1818 | chr10 | ENST00000287139.7 |
| NODAL | CCGGCACCTATAGCTTTCATGTATTCTCGAGAATACATGAAAGCTATAGGTGTTTTTG | 1819 | chr10 | ENST00000287139.7 |
| NODAL | CCGGGCATGCTGTATGTGGATAATGCTCGAGCATTATCCACATACAGCATGCTTTTTG | 1820 | chr10 | ENST00000287139.7 |
| NOG | CCGGAGGTCAGTATTATACGTTAAACTCGAGTTTAACGTATAATACTGACCTTTTTG | 1821 | chr17 | ENST00000332822.4 |
| NOG | CCGGATTCTGGTTGTTGCTAATAATCTCGAGATTATTAGCAACAACCAGAATTTTTG | 1822 | chr17 | ENST00000332822.4 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| NOG | CCGGTGCGGAGGAAGTTACAGATGTCTCGAGACATCTGTAACTTCCTCCGCATTTTTG | 1823 | chr17 | ENST00000332822.4 |
| NRG1 | CCGGGATATCACAGAGGCCTATAACCTCGAGGTTATAGGCCTCTGTGATATCTTTTTG | 1824 | chr8 | ENST00000287842.7 |
| NRG1 | CCGGGGCTGATTCTGGAGAGTATATCTCGAGATATACTCTCCAGAATCAGCCTTTTTG | 1825 | chr8 | ENST00000287842.7 |
| NRG1 | CCGGGACAGTGCCTCTGCCAATATCCTCGAGGATATTGGCAGAGGCACTGTCTTTTTG | 1826 | chr8 | ENST00000287842.7 |
| NRP1 | CCGGTATACTAGAATCACCGCATTTCTCGAGAAATGCGGTGATTCTAGTATATTTTTG | 1827 | chr10 | ENST00000265371.8 |
| NRP1 | CCGGCAGCCTTGAATGCACTTATATCTCGAGATATAAGTGCATTCAAGGCTGTTTTTG | 1828 | chr10 | ENST00000265371.8 |
| NRP1 | CCGGCAGCCTTGAATGCACTTATATCTCGAGATATAAGTGCATTCAAGGCTGTTTTTG | 1829 | chr10 | ENST00000265371.8 |
| NRP2 | CCGGCGACTGCAAGTATGACTTTATCTCGAGATAAAGTCATACTTGCAGTCGTTTTTG | 1830 | chr2 | ENST00000357785.9 |
| NRP2 | CCGGCCGGATTGCTAATGAACAGATCTCGAGATCTGTTCATTAGCAATCCGGTTTTTG | 1831 | chr2 | ENST00000357785.9 |
| NRP2 | CCGGCCTCAACTTCAACCCTCACTTCTCGAGAAGTGAGGGTTGAAGTTGAGGTTTTTG | 1832 | chr2 | ENST00000357785.9 |
| OSM | CCGGACTTCCTCCTTTCCGTGTTTCCTCGAGGAAACACGGAAAGGAGGAAGTTTTTG | 1833 | chr22 | ENST00000215781.2 |
| OSM | CCGGGGACCGACTTTCCATTGATTCCTCGAGGAATCAATGGAAAGTCGGTCCTTTTTG | 1834 | chr22 | ENST00000215781.2 |
| OSM | CCGGTGGTCCTTGCACTCCTGTTTCCTCGAGGAAACAGGAGTGCAAGGACCATTTTTG | 1835 | chr22 | ENST00000215781.2 |
| OSMR | CCGGTAACCTGACTCATCGAGTTTACTCGAGTAAACTCGATGAGTCAGGTTATTTTTG | 1836 | chr5 | ENST00000274276.7 |
| OSMR | CCGGAGGAGAACCCTCACCTAATAACTCGAGTTATTAGGTGAGGGTTCTCCTTTTTTG | 1837 | chr5 | ENST00000274276.7 |
| OSMR | CCGGGCACTCCATAAGGAATAATTTCTCGAGAAATTATTCCTTATGGAGTGCTTTTTG | 1838 | chr5 | ENST00000274276.7 |
| PARK7 | CCGGGTAGCCGTGATGTGGTCATTTCTCGAGAAATGACCACATCACGGCTACTTTTTG | 1839 | chr1 | ENST00000338639.9 |
| PARK7 | CCGGGCAATTGTTGAAGCCCTGAATCTCGAGATTCAGGGCTTCAACAATTGCTTTTTG | 1840 | chr1 | ENST00000338639.9 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| PARK7 | CCGGACTCTGAGAATCGTGTGG AAACTCGAGTTTCCACACGATT CTCAGAGTTTTTG | 1841 | chr1 | ENST00000338639.9 |
| PDPN | CCGGGCCTCTGGTATGAGAAAT AAACTCGAGTTTATTTCTCATAC CAGAGGCTTTTTG | 1842 | chr1 | ENST00000294489.10 |
| PDPN | CCGGAGTCCACGCGCAAGAACA AAGCTCGAGCTTTGTTCTTGCG CGTGGACTTTTTG | 1843 | chr1 | ENST00000294489.10 |
| PDPN | CCGGTGACCCTGGTTGGAATCA TAGCTCGAGCTATGATTCCAAC CAGGGTCATTTTTG | 1844 | chr1 | ENST00000294489.10 |
| PF4 | CCGGACGCTGAAGAATGGAAG GAAACTCGAGTTTCCTTCCATTC TTCAGCGTTTTTG | 1845 | chr4 | ENST00000296029.3 |
| PF4 | CCGGCCAACTGATAGCCACGCT GAACTCGAGTTCAGCGTGGCTA TCAGTTGGTTTTTG | 1846 | chr4 | ENST00000296029.3 |
| PF4 | CCGGCACGCTGAAGAATGGAA GGAACTCGAGTTCCTTCCATTCT TCAGCGTGTTTTTG | 1847 | chr4 | ENST00000296029.3 |
| PF4V1 | CCGGGTTGTGGTATAGTCAATC TATCTCGAGATAGATTGACTAT ACCACAACTTTTTG | 1848 | chr4 | ENST00000226524.3 |
| PF4V1 | CCGGAGCTGCCTAAGTGTGCAC TTTCTCGAGAAAGTGCACACTT AGGCAGCTTTTTG | 1849 | chr4 | ENST00000226524.3 |
| PF4V1 | CCGGCTGACACATCACAATTTC ATACTCGAGTATGAAATTGTGA TGTGTCAGTTTTTG | 1850 | chr4 | ENST00000226524.3 |
| PGLYRP1 | CCGGGTGCCCACTCAGGTCACT TATCTCGAGATAAGTGACCTGA GTGGGCACTTTTTG | 1851 | chr19 | ENST00000008938.4 |
| PGLYRP1 | CCGGCTTACGCTATGTGGTGGT ATCCTCGAGGATACCACCACAT AGCGTAAGTTTTTG | 1852 | chr19 | ENST00000008938.4 |
| PGLYRP1 | CCGGCATCAGCTTCATGGGCAA CTACTCGAGTAGTTGCCCATGA AGCTGATGTTTTTG | 1853 | chr19 | ENST00000008938.4 |
| PLP2 | CCGGCCTGTCGGTGATTGAGAT GATCTCGAGATCATCTCAATCA CCGACAGGTTTTTG | 1854 | chrX | ENST00000376327.5 |
| PLP2 | CCGGCCTGTCGGTGATTGAGAT GATCTCGAGATCATCTCAATCA CCGACAGGTTTTTG | 1855 | chrX | ENST00000376327.5 |
| PLP2 | CCGGCGAAAGGGAATCCTCCTG TTTCTCGAGAAACAGGAGGATT CCCTTTCGTTTTTG | 1856 | chrX | ENST00000376327.5 |
| PPBP | CCGGAGGTGATGAATCTGCTGA TTACTCGAGTAATCAGCAGATT CATCACCTTTTTG | 1857 | chr4 | ENST00000296028.3 |
| PPBP | CCGGTGTTTCTGCCAAACTTCTT TACTCGAGTAAAGAAGTTTGGC AGAAACATTTTTG | 1858 | chr4 | ENST00000296028.3 |

TABLE 15-continued

5' to 3' (Forward) shRNA sequences for Silencing of Cytokine/Chemokine
Genes to Reduce the Incidence of CRS

| Target Gene Symbol | shRNA Forward Oligo Sequence | SEQ ID NO: | Location | Gene ID No. |
|---|---|---|---|---|
| PPBP | CCGGCTCCCAGGAAGGGTAGAATTTCTCGAGAAATTCTACCCTTCCTGGGAGTTTTTG | 1859 | chr4 | ENST00000296028.3 |
| PXDN | CCGGAGATTGCGACTGGACTCAAACCTCGAGGTTTGAGTCCAGTCGCAATCTTTTTG | 1860 | chr2 | ENST00000252804.8 |
| PXDN | CCGGGTTCCTGACGTCAGTCGAAATCTCGAGATTTCGACTGACGTCAGGAACTTTTTG | 1861 | chr2 | ENST00000252804.8 |
| PXDN | CCGGGAAGGATTCTTGACCATCAATCTCGAGATTGATGGTCAAGAATCCTTCTTTTTG | 1862 | chr2 | ENST00000252804.8 |
| RORC | CCGGCACCTCACAAATTGAAGTGATCTCGAGATCACTTCAATTTGTGAGGTGTTTTTG | 1863 | chr1 | ENST00000318247.6 |
| RORC | CCGGGCCCTCATATTCCAACAACTTCTCGAGAAGTTGTTGGAATATGAGGGCTTTTTG | 1864 | chr1 | ENST00000318247.6 |
| RORC | CCGGGCTTCTCAAAGCAGGAGCAATCTCGAGATTGCTCCTGCTTTGAGAAGCTTTTTG | 1865 | chr1 | ENST00000318247.6 |
| RORC | CCGGCGAGGATGAGATTGCCCTCTACTCGAGTAGAGGGCAATCTCATCCTCGTTTTTG | 1866 | chr1 | ENST00000318247.6 |
| SCG2 | CCGGACGACAAGGATCAAGAATTAGCTCGAGCTAATTCTTGATCCTTGTCGTTTTTG | 1867 | chr2 | ENST00000305409.2 |
| SCG2 | CCGGCCTGTCTCTTATCCCTTTAATCTCGAGATTAAAGGGATAAGAGACAGGTTTTTG | 1868 | chr2 | ENST00000305409.2 |
| SCG2 | CCGGGAAAGCAGCCCAGATTATAATCTCGAGATTATAATCTGGGCTGCTTTCTTTTTG | 1869 | chr2 | ENST00000305409.2 |
| SCGB3A1 | CCGGTCATAGAGGGCTCCCAGAAGTCTCGAGACTTCTGGGAGCCCTCTATGATTTTTG | 1870 | chr5 | ENST00000292641.3 |
| SCGB3A1 | CCGGCCCGTGAACCACCTCATAGAGCTCGAGCTCTATGAGGTGGTTCACGGGTTTTTG | 1871 | chr5 | ENST00000292641.3 |
| SCGB3A1 | CCGGGACTGGAGCATCTACACCTGACTCGAGTCAGGTGTAGATGCTCCAGTCTTTTTG | 1872 | chr5 | ENST00000292641.3 |
| SECTM1 | CCGGCACCAGAGAAATAACAGACAACTCGAGTTGTCTGTTATTTCTCTGGTGTTTTTG | 1873 | chr17 | ENST00000269389.7 |
| SECTM1 | CCGGCCATGACTCGAATATCTGAAACTCGAGTTTCAGATATTCGAGTCATGGTTTTTG | 1874 | chr17 | ENST00000269389.7 |
| SECTM1 | CCGGCCATGACTCGAATATCTGAAACTCGAGTTTCAGATATTCGAGTCATGGTTTTTG | 1875 | chr17 | ENST00000269389.7 |
| SLURP1 | CCGGGTGCTTCCTGCAGGACCATTACTCGAGTAATGGTCCTGCAGGAAGCACTTTTTG | 1876 | chr8 | ENST00000246515.1 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| SLURP1 | CCGGAGACCTCTGCAACTCGGAACTCTCGAGAGTTCCGAGTTGCAGAGGTCTTTTTG | 1877 | chr8 | ENST00000246515.1 |
| SLURP1 | CCGGCTCAAGTGCTACACCTGCAAGCTCGAGCTTGCAGGTGTAGCACTTGAGTTTTTG | 1878 | chr8 | ENST00000246515.1 |
| SOSTDC1 | CCGGGATGCCACAGAAATCCTTTATCTCGAGATAAAGGATTTCTGTGGCATCTTTTTG | 1879 | chr7 | ENST00000307068.4 |
| SOSTDC1 | CCGGGGAACTGCGTTCCACCAAATACTCGAGTATTGGTGGAACGCAGTTCCTTTTTG | 1880 | chr7 | ENST00000307068.4 |
| SOSTDC1 | CCGGTGAATCTTCACAGTAACATTTCTCGAGAAATGTTACTGTGAAGATTCATTTTTG | 1881 | chr7 | ENST00000307068.4 |
| SP100 | CCGGGAAGTGAGCCTGTGATCAATACTCGAGTATTGATCACAGGCTCACTTCTTTTTG | 1882 | chr2 | ENST00000340126.8 |
| SP100 | CCGGTATACGCTGCGGTGGATATACCTCGAGGTATATCCACCGCAGCGTATATTTTTG | 1883 | chr2 | ENST00000340126.8 |
| SP100 | CCGGTCGTGATCTCATCACAAATAACTCGAGTTATTTGTGATGAGATCACGATTTTTG | 1884 | chr2 | ENST00000340126.8 |
| SPI1 | CCGGGCCCTATGACACGGATCTATACTCGAGTATAGATCCGTGTCATAGGGCTTTTTG | 1885 | chr11 | ENST00000378538.7 |
| SPI1 | CCGGAGAGCTTCGCCGAGAACAACTCTCGAGAGTTGTTCTCGGCGAAGCTCTTTTTG | 1886 | chr11 | ENST00000378538.7 |
| SPI1 | CCGGCGGATCTATACCAACGCCAAACTCGAGTTTGGCGTTGGTATAGATCCGTTTTTG | 1887 | chr11 | ENST00000378538.7 |
| SPI1 | CCGGCCGTATGTAAATCAGATCTCCCTCGAGGGAGATCTGATTTACATACGGTTTTTG | 1888 | chr11 | ENST00000378538.7 |
| SPP1 | CCGGCCACAAGCAGTCCAGATTATACTCGAGTATAATCTGGACTGCTTGTGGTTTTTG | 1889 | chr4 | ENST00000237623.11 |
| SPP1 | CCGGCCGAGGTGATAGTGTGGTTTACTCGAGTAAACCACACTATCACCTCGGTTTTTG | 1890 | chr4 | ENST00000237623.11 |
| SPP1 | CCGGCTTCAGGGTTATGTCTATGTTCTCGAGAACATAGACATAACCCTGAAGTTTTTG | 1891 | chr4 | ENST00000237623.11 |
| TBX21 | CCGGGCCCTAACTACAGTCGTTTACCTCGAGGTAAACGACTGTAGTTAGGGCTTTTTG | 1892 | ch17 | ENST00000177694.1 |
| TBX21 | CCGGCCTGTTGTGGTCCAAGTTTAACTCGAGTTAAACTTGGACCACAACAGGTTTTTG | 1893 | ch17 | ENST00000177694.1 |
| TBX21 | CCGGCGCTTCCAACACGCATATCTTCTCGAGAAGATATGCGTGTTGGAAGCGTTTTTG | 1894 | ch17 | ENST00000177694.1 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| TBX21 | CCGGACAATGTGACCCAGATGA TTGCTCGAGCAATCATCTGGGT CACATTGTTTTTG | 1895 | ch17 | ENST00000177694.1 |
| TCAP | CCGGCTTTGTAGTTTGCCCAGA GTTCTCGAGAACTCTGGGCAAA CTACAAAGTTTTTG | 1896 | chr17 | ENST00000309889.2 |
| TCAP | CCGGGCCATGGCTGCTTTGTA GTTCTCGAGAACTACAAAGCAG CCATGGCCTTTTTG | 1897 | chr17 | ENST00000309889.2 |
| TCAP | CCGGGGTGGCTGAGATCACAAA GCACTCGAGTGCTTTGTGATCT CAGCCACCTTTTTG | 1898 | chr17 | ENST00000309889.2 |
| TGFB1 | CCGGACTGCGGATCTCTGTGTC ATTCTCGAGAATGACACAGAGA TCCGCAGTTTTTG | 1899 | chr19 | ENST00000221930.5 |
| TGFB1 | CCGGCCACAACGAAATCTATGA CAACTCGAGTTGTCATAGATTT CGTTGTGGTTTTTG | 1900 | chr19 | ENST00000221930.5 |
| TGFB1 | CCGGCCACAACGAAATCTATGA CAACTCGAGTTGTCATAGATTT CGTTGTGGTTTTTG | 1901 | chr19 | ENST00000221930.5 |
| TGFB2 | CCGGGCGGCCTATTGCTTTAGA AATCTCGAGATTTCTAAAGCAA TAGGCCGCTTTTTG | 1902 | chr1 | ENST00000366930.8 |
| TGFB2 | CCGGGCTGGAGCATGCCCGTAT TTACTCGAGTAAATACGGGCAT GCTCCAGCTTTTTG | 1903 | chr1 | ENST00000366930.8 |
| TGFB2 | CCGGTTGCTGCCTACGTCCACTT TACTCGAGTAAAGTGGACGTAG GCAGCAATTTTTG | 1904 | chr1 | ENST00000366930.8 |
| TGFB3 | CCGGCATTGCCAAACAGCGCTA TATCTCGAGATATAGCGCTGTT TGGCAATGTTTTTG | 1905 | chr14 | ENST00000238682.7 |
| TGFB3 | CCGGGCTCTAGGGAATCTGGAT TATCTCGAGATAATCCAGATTC CCTAGAGCTTTTTG | 1906 | chr14 | ENST00000238682.7 |
| TGFB3 | CCGGCGGAATACTATGCCAAAG AAACTCGAGTTTCTTTGGCATA GTATTCCGTTTTTG | 1907 | chr14 | ENST00000238682.7 |
| TGFBR1 | CCGGGCCTTGAGAGTAATGGCT AAACTCGAGTTTAGCCATTACT CTCAAGGCTTTTTG | 1908 | chr9 | ENST00000374994.8 |
| TGFBR1 | CCGGCTCATGTTGATGGTCTAT ATCCTCGAGGATATAGACCATC AACATGAGTTTTTG | 1909 | chr9 | ENST00000374994.8 |
| TGFBR1 | CCGGGAAGTTGCTGTTAAGATA TTCCTCGAGGAATATCTTAACA GCAACTTCTTTTTG | 1910 | chr9 | ENST00000374994.8 |
| TGFBR2 | CCGGCGTTCAGAAGTCGGTTAA TAACTCGAGTTATTAACCGACT TCTGAACGTTTTTG | 1911 | chr3 | ENST00000295754.9 |
| TGFBR2 | CCGGCTCTAGGCTTTATCGTGTT TACTCGAGTAAACACGATAAAG CCTAGAGTTTTTG | 1912 | chr3 | ENST00000295754.9 |

TABLE 15-continued

5' to 3' (Forward) shRNA sequences for Silencing of Cytokine/Chemokine
Genes to Reduce the Incidence of CRS

| Target Gene Symbol | shRNA Forward Oligo Sequence | SEQ ID NO: | Location | Gene ID No. |
| --- | --- | --- | --- | --- |
| TGFBR2 | CCGGCTCAGGAAATGAGATTGA TTTCTCGAGAAATCAATCTCATT TCCTGAGTTTTTG | 1913 | chr3 | ENST00000295754.9 |
| TGFBR3 | CCGGGGAGTTGGTAAAGGGTTA ATACTCGAGTATTAACCCTTTA CCAACTCCTTTTTG | 1914 | chr1 | ENST00000212355.8 |
| TGFBR3 | CCGGTAATGGATTTCCGGGAGA TATCTCGAGATATCTCCCGGAA ATCCATTATTTTTG | 1915 | chr1 | ENST00000212355.8 |
| TGFBR3 | CCGGCACACCCAGGGCTAGTAT AAACTCGAGTTTATACTAGCCC TGGGTGTGTTTTTG | 1916 | chr1 | ENST00000212355.8 |
| THBS1 | CCGGGTAGGTTATGATGAGTTT AATCTCGAGATTAAACTCATCA TAACCTACTTTTTG | 1917 | chr15 | ENST00000260356.5 |
| THBS1 | CCGGCGTGACTGTAAGATTGTA AATCTCGAGATTTACAATCTTA CAGTCACGTTTTTG | 1918 | chr15 | ENST00000260356.5 |
| THBS1 | CCGGGAGATCCCTAATCATCAA ATTCTCGAGAATTTGATGATTA GGGATCTCTTTTTG | 1919 | chr15 | ENST00000260356.5 |
| THNSL2 | CCGGGAGCCGATCAAGACTGTG TTTCTCGAGAAACACAGTCTTG ATCGGCTCTTTTTG | 1920 | chr2 | ENST00000324166.6 |
| THNSL2 | CCGGGCTGCCATTGAGAGTGTT CAACTCGAGTTGAACACTCTCA ATGGCAGCTTTTTG | 1921 | chr2 | ENST00000324166.6 |
| THNSL2 | CCGGGCTGCCATTGAGAGTGTT CAACTCGAGTTGAACACTCTCA ATGGCAGCTTTTTG | 1922 | chr2 | ENST00000324166.6 |
| THPO | CCGGGACCTCCGAGTCCTCAGT AAACTCGAGTTTACTGAGGACT CGGAGGTCTTTTTG | 1923 | chr3 | ENST00000204615.11 |
| THPO | CCGGAGCTAGCTCTTTGGTCTA TTTCTCGAGAAATAGACCAAAG AGCTAGCTTTTTG | 1924 | chr3 | ENST00000204615.11 |
| THPO | CCGGCAACCTCCAGCCTGGATA TTCCTCGAGGAATATCCAGGCT GGAGGTTGTTTTTG | 1925 | chr3 | ENST00000204615.11 |
| TIMP1 | CCGGGCACAGTGTTTCCCTGTTT ATCTCGAGATAAACAGGGAAAC ACTGTGCTTTTTG | 1926 | chrX | ENST00000218388.8 |
| TIMP1 | CCGGGCACAGTGTTTCCCTGTTT ATCTCGAGATAAACAGGGAAAC ACTGTGCTTTTTG | 1927 | chrX | ENST00000218388.8 |
| TIMP1 | CCGGACAGACGGCCTTCTGCAA TTCCTCGAGGAATTGCAGAAGG CCGTCTGTTTTTG | 1928 | chrX | ENST00000218388.8 |
| TNF | CCGGGAACCCAAGCTTAGAACT TTACTCGAGTAAAGTTCTAAGC TTGGGTTCTTTTTG | 1929 | chr6 | ENST00000449264.2 |
| TNF | CCGGGGAGCCAGCTCCCTCTAT TTACTCGAGTAAATAGAGGGAG CTGGCTCCTTTTTG | 1930 | chr6 | ENST00000449264.2 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
| --- | --- | --- | --- | --- |
| TNF | CCGGTGGCGTGGAGCTGAGAGATAACTCGAGTTATCTCTCAGCTCCACGCCATTTTTG | 1931 | chr6 | ENST00000449264.2 |
| TNFRSF4 | CCGGGCACGTGGTGTAACCTCAGAACTCGAGTTCTGAGGTTACACCACGTGCTTTTTG | 1932 | chr1 | ENST00000379236.3 |
| TNFRSF4 | CCGGCAGCAATAGCTCGGACGCAATCTCGAGATTGCGTCCGAGCTATTGCTGTTTTTG | 1933 | chr1 | ENST00000379236.3 |
| TNFRSF4 | CCGGGACAGCTACAAGCCTGGAGTTCTCGAGAACTCCAGGCTTGTAGCTGTCTTTTTG | 1934 | chr1 | ENST00000379236.3 |
| TNFRSF4 | CCGGGCTTCTACAACGACGTGGTCACTCGAGTGACCACGTCGTTGTAGAAGCTTTTTG | 1935 | chr1 | ENST00000379236.3 |
| TNFRSF11 | CCGGTGTTTACTTGCCCGGTTTAATCTCGAGATTAAACCGGGCAAGTAAACATTTTTG | 1936 | chr18 | ENST00000586569.2 |
| TNFRSF11 | CCGGTGTACCAGTGAGAAGCATTATCTCGAGATAATGCTTCTCACTGGTACATTTTTG | 1937 | chr18 | ENST00000586569.2 |
| TNFRSF11 | CCGGTGGGACGGTGCTGTAACAAATCTCGAGATTTGTTACAGCACCGTCCCATTTTTG | 1938 | chr18 | ENST00000586569.2 |
| TNFRSF11 | CCGGGAAAGCACTCACAGCTAATTTCTCGAGAAATTAGCTGTGAGTGCTTTCTTTTTG | 1939 | chr8 | ENST00000297350.8 |
| TNFRSF11 | CCGGGATAAATGCTTGCTGCATAAACTCGAGTTTATGCAGCAAGCATTTATCTTTTTG | 1940 | chr8 | ENST00000297350.8 |
| TNFRSF11 | CCGGCCAGTGTGTGTTCATTGTAAACTCGAGTTTACAATGAACACACACTGGTTTTTG | 1941 | chr8 | ENST00000297350.8 |
| TNFRSF1A | CCGGAGAACCAGTACCGGCATTATTCTCGAGAATAATGCCGGTACTGGTTCTTTTTG | 1942 | chr12 | ENST00000162749.6 |
| TNFRSF1A | CCGGGGAGCTGTTGGTGGGAATATACTCGAGTATATTCCCACCAACAGCTCCTTTTTG | 1943 | chr12 | ENST00000162749.6 |
| TNFRSF1A | CCGGCTTGAAGGAACTACTACTAAGCTCGAGCTTAGTAGTAGTTCCTTCAAGTTTTTG | 1944 | chr12 | ENST00000162749.6 |
| TNFRSF9 | CCGGGCTCCGTTTCTCTGTTGTTAACTCGAGTTAACAACAGAGAAACGGAGCTTTTTG | 1945 | chr1 | ENST00000377507.7 |
| TNFRSF9 | CCGGCAAGAACACCATCCTACATAACTCGAGTTATGTAGGATGGTGTTCTTGTTTTTG | 1946 | chr1 | ENST00000377507.7 |
| TNFRSF9 | CCGGCAGTCCCTGTCCTCCAAATAGCTCGAGCTATTTGGAGGACAGGGACTGTTTTTG | 1947 | chr1 | ENST00000377507.7 |
| TNFSF9 | CCGGCAAGTTGGACCTTGATATTTACTCGAGTAAATATCAAGGTCCAACTTGTTTTTG | 1948 | chr19 | ENST00000245817.4 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| TNFSF9 | CCGGCTACTATGTCTTCTTTCAA CTCTCGAGAGTTGAAAGAAGAC ATAGTAGTTTTTG | 1949 | chr19 | ENST00000245817.4 |
| TNFSF9 | CCGGCCCTTCACCGAGGTCGGA ATACTCGAGTATTCCGACCTCG GTGAAGGGTTTTTG | 1950 | chr19 | ENST00000245817.4 |
| TNFSF9 | CCGGTGAGCTACAAAGAGGAC ACGACTCGAGTCGTGTCCTCTTT GTAGCTCATTTTTG | 1951 | chr19 | ENST00000245817.4 |
| TNFSF10 | CCGGAGAAATAGTTGTTGGTCT AAACTCGAGTTTAGACCAACAA CTATTTCTTTTTG | 1952 | chr3 | ENST00000241261.6 |
| TNFSF10 | CCGGAGTTATCCTGACCCTATA TTGCTCGAGCAATATAGGGTCA GGATAACTTTTTG | 1953 | chr3 | ENST00000241261.6 |
| TNFSF10 | CCGGGACAAACAAATGGTCCAA TATCTCGAGATATTGGACCATT TGTTTGTCTTTTTG | 1954 | chr3 | ENST00000241261.6 |
| TNFSF11 | CCGGCTAATGGTGTACGTCACT AAACTCGAGTTTAGTGACGTAC ACCATTAGTTTTTG | 1955 | chr13 | ENST00000398795.6 |
| TNFSF11 | CCGGCCGGATCAGGATGCAACA TACCTCGAGGTATGTTGCATCC TGATCCGGTTTTTG | 1956 | chr13 | ENST00000398795.6 |
| TNFSF11 | CCGGGCAGTATATTTCTTCGTTC TTCTCGAGAAGAACGAAGAAAT ATACTGCTTTTTG | 1957 | chr13 | ENST00000398795.6 |
| TNFSF12 | CCGGGTATTCCCACTCTTATCTT ACCTCGAGGTAAGATAAGAGTG GGAATACTTTTTG | 1958 | chr17 | ENST00000293825.10 |
| TNFSF12 | CCGGGGGCATTGTGTTCACTGT ACTCTCGAGAGTACAGTGAACA CAATGCCCTTTTTG | 1959 | chr17 | ENST00000293825.10 |
| TNFSF12 | CCGGCAGATGGAGGTTACACAA CTTCTCGAGAAGTTGTGTAACC TCCATCTGTTTTTG | 1960 | chr17 | ENST00000293825.10 |
| TNFSF12- | CCGGCCTCACCTACTTCGGACT CTTCTCGAGAAGAGTCCGAAGT AGGTGAGGTTTTTG | 1961 | chr17 | ENST00000293826.4 |
| TNFSF12- | CCGGCTGTACTGTCAGGTGCAC TTTCTCGAGAAAGTGCACCTGA CAGTACAGTTTTTG | 1962 | chr17 | ENST00000293826.4 |
| TNFSF12- | CCGGGCGCAGGCAGATGGAGG TTACCTCGAGGTAACCTCCATC TGCCTGCGCTTTTTG | 1963 | chr17 | ENST00000293826.4 |
| TNFSF13 | CCGGCAGTTGCCCTCTGGTTGA GTTCTCGAGAACTCAACCAGAG GGCAACTGTTTTTG | 1964 | chr17 | ENST00000338784.8 |
| TNFSF13 | CCGGATGGCTCTGCTGACCCAA CAACTCGAGTTGTTGGGTCAGC AGAGCCATTTTTG | 1965 | chr17 | ENST00000338784.8 |
| TNFSF13 | CCGGCCCAACAAACAGAGCTGC AGACTCGAGTCTGCAGCTCTGT TTGTTGGGTTTTTG | 1966 | chr17 | ENST00000338784.8 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| TNFSF13B | CCGGCCTGAAACACTACCCAAT AATCTCGAGATTATTGGGTAGT GTTTCAGGTTTTTG | 1967 | chr13 | ENST00000375887.8 |
| TNFSF13B | CCGGCTACGCCATGGGACATCT AATCTCGAGATTAGATGTCCCA TGGCGTAGTTTTTG | 1968 | chr13 | ENST00000375887.8 |
| TNFSF13B | CCGGGTGACTTTGTTTCGATGT ATTCTCGAGAATACATCGAAAC AAAGTCACTTTTTG | 1969 | chr13 | ENST00000375887.8 |
| TNFSF14 | CCGGTCCTGGGAGCAGCTGATA CAACTCGAGTTGTATCAGCTGC TCCCAGGATTTTTG | 1970 | chr19 | ENST00000599359.1 |
| TNFSF14 | CCGGGACAGACCGACATCCCAT TCACTCGAGTGAATGGGATGTC GGTCTGTCTTTTTG | 1971 | chr19 | ENST00000599359.1 |
| TNFSF14 | CCGGATGGGTCTGACACGTGGA GAACTCGAGTTCTCCACGTGTC AGACCCATTTTTG | 1972 | chr19 | ENST00000599359.1 |
| TNFSF15 | CCGGATTAAGACACTGATCACT AAACTCGAGTTTAGTGATCAGT GTCTTAATTTTTG | 1973 | chr9 | ENST00000374045.4 |
| TNFSF15 | CCGGGTCGGGAGACTACTTCAT TTACTCGAGTAAATGAAGTAGT CTCCCGACTTTTTG | 1974 | chr9 | ENST00000374045.4 |
| TNFSF15 | CCGGACTATAGGAGGAGAGCA AATACTCGAGTATTTGCTCTCCT CCTATAGTTTTTG | 1975 | chr9 | ENST00000374045.4 |
| TNFSF18 | CCGGCCTTCAGTTGGCTAATCTT TACTCGAGTAAAGATTAGCCAA CTGAAGGTTTTTG | 1976 | chr1 | ENST00000404377.3 |
| TNFSF18 | CCGGCTGAACCTCCTTGCGTGA ATACTCGAGTATTCACGCAAGG AGGTTCAGTTTTTG | 1977 | chr1 | ENST00000404377.3 |
| TNFSF18 | CCGGATGATACAAACTCTAACA AACCTCGAGGTTTGTTAGAGTT TGTATCATTTTTG | 1978 | chr1 | ENST00000404377.3 |
| TNFSF4 | CCGGGTGGCCTCTCTGACTTAC AAACTCGAGTTTGTAAGTCAGA GAGGCCACTTTTTG | 1979 | chr1 | ENST00000281834.3 |
| TNFSF4 | CCGGGCAGAACAACTCAGTCAT CATCTCGAGATGATGACTGAGT TGTTCTGCTTTTTG | 1980 | chr1 | ENST00000281834.3 |
| TNFSF4 | CCGGGCCAAGATTCGAGAGGA ACAACTCGAGTTGTTCCTCTCG AATCTTGGCTTTTTG | 1981 | chr1 | ENST00000281834.3 |
| TNFSF8 | CCGGACTGTATGGTCTTGATCT ATTCTCGAGAATAGATCAAGAC CATACAGTTTTTG | 1982 | chr9 | ENST00000223795.2 |
| TNFSF8 | CCGGCAAACTACACAGGGTATT AAACTCGAGTTTAATACCCTGT GTAGTTTGTTTTTG | 1983 | chr9 | ENST00000223795.2 |
| TNFSF8 | CCGGGTGGATACATTCCAGTAC ATACTCGAGTATGTACTGGAAT GTATCCACTTTTTG | 1984 | chr9 | ENST00000223795.2 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| TNFSF9 | CCGGCAAGTTGGACCTTGATAT TTACTCGAGTAAATATCAAGGT CCAACTTGTTTTTG | 1985 | chr19 | ENST00000245817.4 |
| TNFSF9 | CCGGCTACTATGTCTTCTTTCAA CTCTCGAGAGTTGAAAGAAGAC ATAGTAGTTTTTG | 1986 | chr19 | ENST00000245817.4 |
| TNFSF9 | CCGGCCCTTCACCGAGGTCGGA ATACTCGAGTATTCCGACCTCG GTGAAGGGTTTTTG | 1987 | chr19 | ENST00000245817.4 |
| TRIM16 | CCGGGCCGTTGTTCAGCGCAAA TATCTCGAGATATTTGCGCTGA ACAACGGCTTTTTG | 1988 | chr17 | ENST00000336708.11 |
| TRIM16 | CCGGGCCGTTGTTCAGCGCAAA TATCTCGAGATATTTGCGCTGA ACAACGGCTTTTTG | 1989 | chr17 | ENST00000336708.11 |
| TRIM16 | CCGGCCGCATCAGGTGAACATC AAACTCGAGTTTGATGTTCACC TGATGCGGTTTTTG | 1990 | chr17 | ENST00000336708.11 |
| TSLP | CCGGACTCAATGATAGCACCTA AACCTCGAGGTTTAGGTGCTAT CATTGAGTTTTTG | 1991 | chr5 | ENST00000344895.3 |
| TSLP | CCGGCGTCGCTTCAATCGACCT TTACTCGAGTAAAGGTCGATTG AAGCGACGTTTTTG | 1992 | chr5 | ENST00000344895.3 |
| TSLP | CCGGCCATCTTTATTATGGTCAT ATCTCGAGATATGACCATAATA AAGATGGTTTTTG | 1993 | chr5 | ENST00000344895.3 |
| TWSG1 | CCGGGACTGTGTTGGTATGTGT AATCTCGAGATTACACATACCA ACACAGTCTTTTTG | 1994 | chr18 | ENST00000262120.9 |
| TWSG1 | CCGGGCGCCTTATTCCAGTGAC AAACTCGAGTTTGTCACTGGAA TAAGGCGCTTTTTG | 1995 | chr18 | ENST00000262120.9 |
| TWSG1 | CCGGGAATCACTGAGCTGTAAC AAACTCGAGTTTGTTACAGCTC AGTGATTCTTTTTG | 1996 | chr18 | ENST00000262120.9 |
| TXLNA | CCGGGCACATACTGTGTGGACA ATACTCGAGTATTGTCCACACA GTATGTGCTTTTTG | 1997 | chr1 | ENST00000373609.1 |
| TXLNA | CCGGTGCTGATGCAGACATTGA ATACTCGAGTATTCAATGTCTG CATCAGCATTTTTG | 1998 | chr1 | ENST00000373609.1 |
| TXLNA | CCGGAGCGAGGTATTCACCACA TTCCTCGAGGAATGTGGTGAAT ACCTCGCTTTTTG | 1999 | chr1 | ENST00000373609.1 |
| VASN | CCGGAGCTTGACTACGCCGACT TTGCTCGAGCAAAGTCGGCGTA GTCAAGCTTTTTG | 2000 | chr16 | ENST00000304735.3 |
| VASN | CCGGAGCCAACAGGCTGCATGA AATCTCGAGATTTCATGCAGCC TGTTGGCTTTTTG | 2001 | chr16 | ENST00000304735.3 |
| VASN | CCGGGAGATCCTTTCCCATTTAT TCCTCGAGGAATAAATGGGAAA GGATCTCTTTTTG | 2002 | chr16 | ENST00000304735.3 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| VEGFA | CCGGCAAGATCCGCAGACGTGTAAACTCGAGTTTACACGTCTGCGGATCTTGTTTTTG | 2003 | chr6 | ENST00000425836.6 |
| VEGFA | CCGGCAAGATCCGCAGACGTGTAAACTCGAGTTTACACGTCTGCGGATCTTGTTTTTG | 2004 | chr6 | ENST00000425836.6 |
| VEGFA | CCGGGCGCAAGAAATCCCGGTATAACTCGAGTTATACCGGGATTTCTTGCGCTTTTTG | 2005 | chr6 | ENST00000425836.6 |
| VSTM1 | CCGGATGAATATGCGGCACTGAAAGCTCGAGCTTTCAGTGCCGCATATTCATTTTTTG | 2006 | chr19 | ENST00000338372.6 |
| VSTMI | CCGGCATTCCCAGAATGTGACATTTCTCGAGAAATGTCACATTCTGGGAATGTTTTTG | 2007 | chr19 | ENST00000338372.6 |
| VSTM1 | CCGGGAGTGACCTATGCTGAGCTAACTCGAGTTAGCTCAGCATAGGTCACTCTTTTTG | 2008 | chr19 | ENST00000338372.6 |
| WFIKKN1 | CCGGTGCGCCCTGATCAGATGTATGCTCGAGCATACATCTGATCAGGGCGCATTTTTG | 2009 | chr16 | ENST00000319070.2 |
| WFIKKN1 | CCGGGGACGTGCTCAAGGATGACAACTCGAGTTGTCATCCTTGAGCACGTCCTTTTTG | 2010 | chr16 | ENST00000319070.2 |
| WFIKKN1 | CCGGAGTGCTGCATCAACGTGTGTGCTCGAGCACACACGTTGATGCAGCACTTTTTG | 2011 | chr16 | ENST00000319070.2 |
| WFIKKN2 | CCGGTCAAGTTCTTGGGCACCAAGTCTCGAGACTTGGTGCCCAAGAACTTGATTTTTG | 2012 | chr17 | ENST00000311378.4 |
| WFIKKN2 | CCGGTACAACCGCTGCTATATGGACCTCGAGGTCCATATAGCAGCGGTTGTATTTTTG | 2013 | chr17 | ENST00000311378.4 |
| WFIKKN2 | CCGGCACCAGCTTGCTCAGATATTCCTCGAGGAATATCTGAGCAAGCTGGTGTTTTTG | 2014 | chr17 | ENST00000311378.4 |
| WNT1 | CCGGCTGTCGAGAAACGGCGTTTATCTCGAGATAAACGCCGTTTCTCGACAGTTTTTG | 2015 | chr12 | ENST00000293549.3 |
| WNT1 | CCGGGACCTCGTCTACTTCGAGAAACTCGAGTTTCTCGAAGTAGACGAGGTCTTTTTG | 2016 | chr12 | ENST00000293549.3 |
| WNT1 | CCGGGCCACGAGTTTGGATGTTGTACTCGAGTACAACATCCAAACTCGTGGCTTTTTG | 2017 | chr12 | ENST00000293549.3 |
| WNT2 | CCGGCCACAAATGGTCCCAATTAAGCTCGAGCTTAATTGGGACCATTTGTGGTTTTTG | 2018 | chr7 | ENST00000265441.7 |
| WNT2 | CCGGTCGGGAATCTGCCTTTGTTTACTCGAGTAAACAAAGGCAGATTCCCGATTTTTG | 2019 | chr7 | ENST00000265441.7 |
| WNT2 | CCGGTTGACTATGGGATCAAATTTGCTCGAGCAAATTTGATCCCATAGTCAATTTTTG | 2020 | chr7 | ENST00000265441.7 |

TABLE 15-continued

5' to 3' (Forward) shRNA sequences for Silencing of Cytokine/Chemokine Genes to Reduce the Incidence of CRS

| Target Gene Symbol | shRNA Forward Oligo Sequence | SEQ ID NO: | Location | Gene ID No. |
|---|---|---|---|---|
| WNT5A | CCGGCTCCCAGGACCCGCTTAT TTACTCGAGTAAATAAGCGGGT CCTGGGAGTTTTTG | 2021 | chr3 | ENST00000264634.8 |
| WNT5A | CCGGCAAAGAATGCCAGTATCA ATTCTCGAGAATTGATACTGGC ATTCTTTGTTTTTG | 2022 | chr3 | ENST00000264634.8 |
| WNT5A | CCGGCCTGTTCAGATGTCAGAA GTACTCGAGTACTTCTGACATC TGAACAGGTTTTTG | 2023 | chr3 | ENST00000264634.8 |
| WNT7A | CCGGCATAGGAGAAGGCTCACA AATCTCGAGATTTGTGAGCCTT CTCCTATGTTTTTG | 2024 | chr3 | ENST00000285018.4 |
| WNT7A | CCGGGGCGCAAGCATCATCTGT AACCTCGAGGTTACAGATGATG CTTGCGCCTTTTTG | 2025 | chr3 | ENST00000285018.4 |
| WNT7A | CCGGTCTTCGGGAAGGAGCTCA AAGCTCGAGCTTTGAGCTCCTT CCCGAAGATTTTTG | 2026 | chr3 | ENST00000285018.4 |
| XCL1 | CCGGGCTGTGACAATGGCAACA ATTCTCGAGAATTGTTGCCATT GTCACAGCTTTTTG | 2027 | chr1 | ENST00000367818.3 |
| XCL1 | CCGGTTCAACTTGTCTCTATAAT AGCTCGAGCTATTATAGAGACA AGTTGAATTTTTG | 2028 | chr1 | ENST00000367818.3 |
| XCL1 | CCGGAGATTCTGGCTAGTGTCT ATCCTCGAGGATAGACACTAGC CAGAATCTTTTTG | 2029 | chr1 | ENST00000367818.3 |
| XCL2 | CCGGACTGCCAGTTAGCAGAAT CAACTCGAGTTGATTCTGCTAA CTGGCAGTTTTTG | 2030 | chr1 | ENST00000367819.2 |
| XCL2 | CCGGGTAGGGAGTGAAGTCTCA CATCTCGAGATGTGAGACTTCA CTCCCTACTTTTTG | 2031 | chr1 | ENST00000367819.2 |
| XCL2 | CCGGGAAATCCAACACCAGAA ATAACTCGAGTTATTTCTGGTGT TGGATTTCTTTTTG | 2032 | chr1 | ENST00000367819.2 |
| ZFP36 | CCGGGATCCGACCCTGATGAAT ATGCTCGAGCATATTCATCAGG GTCGGATCTTTTTG | 2033 | chr19 | ENST00000597629.1 |
| ZFP36 | CCGGATCTGTCTCCTAGAATCTT ATCTCGAGATAAGATTCTAGGA GACAGATTTTTTG | 2034 | chr19 | ENST00000597629.1 |
| ZFP36 | CCGGCCCTTTATTTATGACGACT TTCTCGAGAAAGTCGTCATAAA TAAAGGGTTTTTG | 2035 | chr19 | ENST00000597629.1 |

TABLE 16

3' to 5' (Reverse) shRNA sequences for Silencing of Cytokine/Chemokine
Genes to Reduce the Incidence of CRS

| Target Gene Symbol | shRNA Reverse Oligo Sequence | SEQ ID NO: | Location | Gene ID No. |
|---|---|---|---|---|
| A2M | AATTCAAAAAGGCGTCCCTATACCAAATAACTCGAGTTATTTGGTATAGGGACGCCT | 2036 | chr12 | ENST00000318602.11 |
| A2M | AATTCAAAAAGACTGCATCAATCGTCATAACTCGAGTTATGACGATTGATGCAGTCT | 2037 | chr12 | ENST00000318602.11 |
| A2M | AATTCAAAAACCTCCAGACATCCTTGAAATACTCGAGTATTTCAAGGATGTCTGGAGG | 2038 | chr12 | ENST00000318602.11 |
| ACKR1 | AATTCAAAAATCCTGTGGGCCTGGTTTATTCTCGAGAATAAACCAGGCCCACAGGAT | 2039 | chr1 | ENST00000368122.2 |
| ACKR1 | AATTCAAAAATGGCAGAAGCCCTGGCAATTTCTCGAGAAATTGCCAGGGCTTCTGCCA | 2040 | chr1 | ENST00000368122.2 |
| ACKR1 | AATTCAAAAAGGCGGATGGTTGAGATCTATCCTCGAGGATAGATCTCAACCATCCGCC | 2041 | chr1 | ENST00000368122.2 |
| ACKR2 | AATTCAAAAAGAGCACTCTTTATACTATTAACTCGAGTTAATAGTATAAAGAGTGCTC | 2042 | chr3 | ENST00000422265.5 |
| ACKR2 | AATTCAAAAAGTGGAACTGCCACGCAGATTTCTCGAGAAATCTGCGTGGCAGTTCCAC | 2043 | chr3 | ENST00000422265.5 |
| ACKR2 | AATTCAAAAACATTGGGTCTTCGGGAGTTTCCTCGAGGAAACTCCCGAAGACCCAATG | 2044 | chr3 | ENST00000422265.5 |
| ACKR3 | AATTCAAAAACACTATTGGTGTACCTTATAACTCGAGTTATAAGGTACACCAATAGTG | 2045 | chr2 | ENST00000272928.3 |
| ACKR3 | AATTCAAAAAGGCATAGTGCTGACATATATTCTCGAGAATATATGTCAGCACTATGCC | 2046 | chr2 | ENST00000272928.3 |
| ACKR3 | AATTCAAAAAGCCGTTCCCTTCTCCATTATCCTCGAGGATAATGGAGAAGGGAACGGC | 2047 | chr2 | ENST00000272928.3 |
| ACVR1 | AATTCAAAAATGATAATTCCCTCGACAAATTCTCGAGAATTTGTCGAGGGAATTATCA | 2048 | chr2 | ENST00000263640.7 |
| ACVR1 | AATTCAAAAAGCAGAACGTATTTAGCCATTACTCGAGTAATGGCTAAATACGTTCTGC | 2049 | chr2 | ENST00000263640.7 |
| ACVR1 | AATTCAAAAACTGGTCTGTCTTTGGATAATACTCGAGTATTATCCAAAGACAGACCAG | 2050 | chr2 | ENST00000263640.7 |
| ACVR2B | AATTCAAAAATGTCACGAGGCCTCTCATACCTCGAGGTATGAGAGGCCTCGTGACAT | 2051 | chr3 | ENST00000352511.4 |
| ACVR2B | AATTCAAAAACCCAGCTCATGAATGACTTTGCTCGAGCAAAGTCATTCATGAGCTGGG | 2052 | chr3 | ENST00000352511.4 |
| ACVR2B | AATTCAAAAACTTTGGCTTGGCTGTTCGATTCTCGAGAATCGAACAGCCAAGCCAAAG | 2053 | chr3 | ENST00000352511.4 |
| ACVRL1 | AATTCAAAAACCGGGAGACTGAGATCTATAACTCGAGTTATAGATCTCAGTCTCCCGG | 2054 | chr12 | ENST00000388922.8 |
| ACVRL1 | AATTCAAAAACAGGAGCACCTGATTCCTTTCCTCGAGGAAAGGAATCAGGTGCTCCTG | 2055 | chr12 | ENST00000388922.8 |
| ACVRL1 | AATTCAAAAACGTGGAGATCTTCGGTACACACTCGAGTGTGTACCGAAGATCTCCACG | 2056 | chr12 | ENST00000388922.8 |
| ADIPOQ | AATTCAAAAAGTTGGAGGCCTTTAGATATTACTCGAGTAATATCTAAAGGCCTCCAAC | 2057 | chr3 | ENST00000320741.6 |
| ADIPOQ | AATTCAAAAAATGCTCATATCAATCCTATAACTCGAGTTATAGGATTGATATGAGCAT | 2058 | chr3 | ENST00000320741.6 |
| ADIPOQ | AATTCAAAAACGGTTAGGAAGTTGATTATTCTCGAGAATAATCAACTTCCTAACCGT | 2059 | chr3 | ENST00000320741.6 |
| AGER | AATTCAAAAACACACTGCAGTCGGAGCTAATCTCGAGATTAGCTCCGACTGCAGTGTG | 2060 | chr6 | ENST00000375076.8 |
| AGER | AATTCAAAAAGAAGCCAGAAATTGTAGATTCCTCGAGGAATCTACAATTTCTGGCTTC | 2061 | chr6 | ENST00000375076.8 |
| AGER | AATTCAAAAATGCTGATCCTCCCTGAGATAGCTCGAGCTATCTCAGGGAGGATCAGCA | 2062 | chr6 | ENST00000375076.8 |
| AGRN | AATTCAAAAAGAGTTCTGTGTGGAAGATAAACTCGAGTTTATCTTCCACACAGAACTC | 2063 | chr1 | ENST00000379370.6 |
| AGRN | AATTCAAAAAGCGCACGTATGACAGTGATTGCTCGAGCAATCACTGTCATACGTGCGC | 2064 | chr1 | ENST00000379370.6 |
| AGRN | AATTCAAAAACGACGGAGTCACCTACGAAACTCGAGTTTCGTAGGTGACTCCGTCGT | 2065 | chr1 | ENST00000379370.6 |
| AHR | AATTCAAAAACGGCATAGAGACCGACTTAATCTCGAGATTAAGTCGGTCTCTATGCCG | 2066 | chr7 | ENST00000242057.8 |
| AHR | AATTCAAAAAGCGGCATAGAGACCGACTTACTCGAGTTAAGTCGGTCTCTATGCCGC | 2067 | chr7 | ENST00000242057.8 |
| AHR | AATTCAAAAATCCACAGTCAGCCATAATAACTCGAGTTATTATGGCTGACTGTGGAT | 2068 | chr7 | ENST00000242057.8 |
| AHR | AATTCAAAAACTGCTTAAAGTTGGTATTAACTCGAGTTAATACCAACTTTAAGCAGT | 2069 | chr7 | ENST00000242057.8 |
| AIMP1 | AATTCAAAAACAGCCTGATCTTCACACTAATCTCGAGATTAGTGTGAAGATCAGGCTG | 2070 | chr4 | ENST00000358008.7 |
| AIMP1 | AATTCAAAAAGAAGTAGATGTCGGAGAAATCTCGAGATTTCTCCGACATCTACTTCT | 2071 | chr4 | ENST00000358008.7 |
| AIMP1 | AATTCAAAAAGCCAGAGTAACCCTGACTAATCTCGAGATTAGTCAGGGTTACTCTGGC | 2072 | chr4 | ENST00000358008.7 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| AREG | AATTCAAAAACCTCTTTCCAGTGGATCATAACTCGAGTTATGATCCACTGGAAAGAGG | 2073 | chr4 | ENST00000395748.7 |
| AREG | AATTCAAAAATACTCGGCTCAGGCCATTATGCTCGAGCATAATGGCCTGAGCCGAGTA | 2074 | chr4 | ENST00000395748.7 |
| AREG | AATTCAAAAAATTCACGGAGAATGCAAATATCTCGAGATATTTGCATTCTCCGTGAAT | 2075 | chr4 | ENST00000395748.7 |
| BCL6 | AATTCAAAAATGTGCCACAGCAATATCTATTCTCGAGAATAGATATTGCTGTGGCACA | 2076 | chr3 | ENST00000406870.6 |
| BCL6 | AATTCAAAAACTGCGTTAAAGGCTCGATTTCTCGAGAAATCGAGCCTTTAACGCAGT | 2077 | chr3 | ENST00000406870.6 |
| BCL6 | AATTCAAAAACCGGCTCAATAACATCGTTAACTCGAGTTAACGATGTTATTGAGCCGG | 2078 | chr3 | ENST00000406870.6 |
| BCL6 | AATTCAAAAACAAGCCAGCCGGCTCAATAACTCGAGTTATTGAGCCGGCTGGCTTGT | 2079 | chr3 | ENST00000406870.6 |
| BMP1 | AATTCAAAAACTGACGAGGACAGCTATATTCTCGAGAATATAGCTGTCCTCGTCAGT | 2080 | chr8 | ENST00000306385.9 |
| BMP1 | AATTCAAAAAGCTCGTAAGTCCTCCATCAAACTCGAGTTTGATGGAGGACTTACGAGC | 2081 | chr8 | ENST00000306385.9 |
| BMP1 | AATTCAAAAACAGCTGTGCCTACGACTATCCTCGAGGATAGTCGTAGGCACAGCTGT | 2082 | chr8 | ENST00000306385.9 |
| BMP10 | AATTCAAAAAGCAAGACGGTGTCGACTTTACTCGAGTAAAGTCGACACCGTCTTGCT | 2083 | chr2 | ENST00000295379.1 |
| BMP10 | AATTCAAAAAGCGTCGTCACCTACAAGTTTACTCGAGTAAACTTGTAGGTGACGACGC | 2084 | chr2 | ENST00000295379.1 |
| BMP10 | AATTCAAAAACATGGCTGAACTTAGGCTATACTCGAGTATAGCCTAAGTTCAGCCATG | 2085 | chr2 | ENST00000295379.1 |
| BMP15 | AATTCAAAAATACTACGCGATGGTCTCAATTCTCGAGAATTGAGACCATCGCGTAGTA | 2086 | chrX | ENST00000252677.3 |
| BMP15 | AATTCAAAAAGCCTTCTTGTTACTCTATTTCCTCGAGGAAATAGAGTAACAAGAAGGC | 2087 | chrX | ENST00000252677.3 |
| BMP15 | AATTCAAAAATGGAACACAGGGCCCAAATGCTCGAGCATTTGGGCCCTGTGTTCCAT | 2088 | chrX | ENST00000252677.3 |
| BMP2 | AATTCAAAAAGATCATCTGAACTCCACTAATCTCGAGATTAGTGGAGTTCAGATGATC | 2089 | chr20 | ENST00000378827.4 |
| BMP2 | AATTCAAAAACCGGAGATTCTTCTTTAATTTCTCGAGAAATTAAAGAAGAATCTCCGG | 2090 | chr20 | ENST00000378827.4 |
| BMP2 | AATTCAAAAACAAGATGCTTTAGGAAACAATCTCGAGATTGTTTCCTAAAGCATCTTG | 2091 | chr20 | ENST00000378827.4 |
| BMP3 | AATTCAAAAACTTACAGGGACACCGGAATTTCTCGAGAAATTCCGGTGTCCCTGTAAG | 2092 | chr4 | ENST00000282701.2 |
| BMP3 | AATTCAAAAAGGCCAAATCTCATCGAGATATCTCGAGATATCTCGATGAGATTTGGCC | 2093 | chr4 | ENST00000282701.2 |
| BMP3 | AATTCAAAAAGTGGATTGAACCTCGGAATTGCTCGAGCAATTCCGAGGTTCAATCCAC | 2094 | chr4 | ENST00000282701.2 |
| BMP4 | AATTCAAAAACCCTGGTCAATTCTGTCAATTCTCGAGAATTGACAGAATTGACCAGGG | 2095 | chr14 | ENST00000245451.8 |
| BMP4 | AATTCAAAAATCCTTGAGGATAGACAGATATCTCGAGATATCTGTCTATCCTCAAGGA | 2096 | chr14 | ENST00000245451.8 |
| BMP4 | AATTCAAAAAGGGCCAGCATGTCAGGATTACTCGAGTAATCCTGACATGCTGGCCCT | 2097 | chr14 | ENST00000245451.8 |
| BMP5 | AATTCAAAAATGGACGCAGTATCAACGTAAACTCGAGTTTACGTTGATACTGCGTCCA | 2098 | chr6 | ENST00000370830.3 |
| BMP5 | AATTCAAAAACCAGAAGGATACGCTGCATTTCTCGAGAAATGCAGCGTATCCTTCTGG | 2099 | chr6 | ENST00000370830.3 |
| BMP5 | AATTCAAAAATGCCACCAACCACGCTATAGCTCGAGCTATAGCGTGGTTGGTGGCAT | 2100 | chr6 | ENST00000370830.3 |
| BMP6 | AATTCAAAAATACAGGAATATGGTTGTAAGCTCGAGCTTACAACCATATTCCTGTAT | 2101 | chr6 | ENST00000283147.6 |
| BMP6 | AATTCAAAAACGCCGACAACAGAGTCGTAATCTCGAGATTACGACTCTGTTGTCGGCG | 2102 | chr6 | ENST00000283147.6 |
| BMP6 | AATTCAAAAACTGTCTATCAAAGGTAGATTTCTCGAGAAATCTACCTTTGATAGACAG | 2103 | chr6 | ENST00000283147.6 |
| BMP7 | AATTCAAAAACGTTCCGGATCAGCGTTTATCTCGAGATAAACGCTGATCCGGAACGT | 2104 | chr20 | ENST00000395863.7 |
| BMP7 | AATTCAAAAACTCGTTTCCAGAGGTAATTACTCGAGTAATTACCTCTGGAAACGAGT | 2105 | chr20 | ENST00000395863.7 |
| BMP7 | AATTCAAAAACCATCGAGAGTTCCGGTTTGCTCGAGCAAACCGGAACTCTCGATGGT | 2106 | chr20 | ENST00000395863.7 |
| BMP8A | AATTCAAAAAGGGTGCAGTTAGCATATTAGCTCGAGCTAATATGCTAACTGCACCCT | 2107 | chr1 | ENST00000331593.5 |
| BMP8A | AATTCAAAAAGCACAGAAGTCCTATCTTAGCTCGAGCTAAGATAGGACTTCTGTGCT | 2108 | chr1 | ENST00000331593.5 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| BMP8A | AATTCAAAAAGGTACAACACTGGCCATTTCCTCGAGGAAATGGCCAGTGTTGTACCT | 2109 | chr1 | ENST00000331593.5 |
| BMP8B | AATTCAAAAACCAAGGCTACTCGGCCTATTACTCGAGTAATAGGCCGAGTAGCCTTGG | 2110 | chr1 | ENST00000372827.7 |
| BMP8B | AATTCAAAAAGACCCTCACAACCACGTACATCTCGAGATGTACGTGGTTGTGAGGGTC | 2111 | chr1 | ENST00000372827.7 |
| BMP8B | AATTCAAAAACGTTAACATGGTGGAGCGAGACTCGAGTCTCGCTCCACCATGTTAACG | 2112 | chr1 | ENST00000372827.7 |
| BMPR2 | AATTCAAAAAGAACGGCTATGTGCGTTTAAACTCGAGTTTAAACGCACATAGCCGTTC | 2113 | chr2 | ENST00000374580.8 |
| BMPR2 | AATTCAAAAAGCCTATGGAGTGAAATTATTTCTCGAGAAATAATTTCACTCCATAGGC | 2114 | chr2 | ENST00000374580.8 |
| BMPR2 | AATTCAAAAAATTACCACGAGGAGATCATTACTCGAGTAATGATCTCCTCGTGGTAAT | 2115 | chr2 | ENST00000374580.8 |
| C10orf99 | AATTCAAAAACATCATGTGAGGCTCTGTAAACTCGAGTTTACAGAGCCTCACATGATG | 2116 | chr10 | ENST00000372126.3 |
| C10orf99 | AATTCAAAAACCCAACTCAACAAACCTGAAACTCGAGTTTCAGGTTTGTTGAGTTGGG | 2117 | chr10 | ENST00000372126.3 |
| C10orf99 | AATTCAAAAAGCCATCAACTTTCAGAGCTATCTCGAGATAGCTCTGAAAGTTGATGGC | 2118 | chr10 | ENST00000372126.3 |
| C1QTNF4 | AATTCAAAAAACACCGAGTTCGTCAACATTGCTCGAGCAATGTTGACGAACTCGGTGT | 2119 | chr11 | ENST00000302514.3 |
| C1QTNF4 | AATTCAAAAAGCGTAAGACGCTGTCGGTTAACTCGAGTTAACCGACAGCGTCTTACGC | 2120 | chr11 | ENST00000302514.3 |
| C1QTNF4 | AATTCAAAAACGAGGTGCAGGCCATGATTTACTCGAGTAAATCATGGCCTGCACCTCG | 2121 | chr11 | ENST00000302514.3 |
| C5 | AATTCAAAAAACGATGGAGCCTGCGTTAATACTCGAGTATTAACGCAGGCTCCATCGT | 2122 | chr9 | ENST00000223642.2 |
| C5 | AATTCAAAAATCCCGACTTCTGGTCTATTACCTCGAGGTAATAGACCAGAAGTCGGGA | 2123 | chr9 | ENST00000223642.2 |
| C5 | AATTCAAAAAGCCCGAGAGAACAGCTTATATCTCGAGATATAAGCTGTTCTCTCGGGC | 2124 | chr9 | ENST00000223642.2 |
| CCL1 | AATTCAAAAAGCAATCCTGTGTTACAGAAATCTCGAGATTTCTGTAACACAGGATTGC | 2125 | chr17 | ENST00000225842.3 |
| CCL1 | AATTCAAAAACTGCTCCAATGAGGGCTTAATCTCGAGATTAAGCCCTCATTGGAGCAG | 2126 | chr17 | ENST00000225842.3 |
| CCL1 | AATTCAAAAACCTGAGGGCAATCCTGTGTTACTCGAGTAACACAGGATTGCCCTCAGG | 2127 | chr17 | ENST00000225842.3 |
| CCL11 | AATTCAAAAACCAACTCCAAAGCCATAAATACTCGAGTATTTATGGCTTTGGAGTTGG | 2128 | chr17 | ENST00000305869.3 |
| CCL11 | AATTCAAAAACATTCTGAGGTAACCTCATTACTCGAGTAATGAGGTTACCTCAGAATG | 2129 | chr17 | ENST00000305869.3 |
| CCL11 | AATTCAAAAATCCTCCATGAATATCAGTTATCTCGAGATAACTGATATTCATGGAGGA | 2130 | chr17 | ENST00000305869.3 |
| CCL13 | AATTCAAAAATGGAATACTTCTACCATAATTCTCGAGAATTATGGTAGAAGTATTCCA | 2131 | chr17 | ENST00000225844.6 |
| CCL13 | AATTCAAAAATCAAGCTGGAGTACGTGAAATCTCGAGATTTCACGTACTCCAGCTTGA | 2132 | chr17 | ENST00000225844.6 |
| CCL13 | AATTCAAAAAACTCAACGTCCCATCTACTTGCTCGAGCAAGTAGATGGGACGTTGAGT | 2133 | chr17 | ENST00000225844.6 |
| CCL14 | AATTCAAAAACCTAGGGACCAAGACTGAATCCTCGAGGATTCAGTCTTGGTCCCTAGG | 2134 | chr17 | ENST00000618404.4 |
| CCL14 | AATTCAAAAACAGCGGATTATGGATTACTATCTCGAGATAGTAATCCATAATCCGCTG | 2135 | chr17 | ENST00000618404.4 |
| CCL14 | AATTCAAAAACAAGCCCGGAATTGTCTTCATCTCGAGATGAAGACAATTCCGGGCTTG | 2136 | chr17 | ENST00000618404.4 |
| CCL15 | AATTCAAAAAGCTGAAGCCCTACTCAATATACTCGAGTATATTGAGTAGGGCTTCAGC | 2137 | chr17 | ENST00000617897.1 |
| CCL15 | AATTCAAAAACAGAGTTAATGATGTCAAAGCTCGAGCTTTGACATCATTAACTCTGT | 2138 | chr17 | ENST00000617897.1 |
| CCL15 | AATTCAAAAATCCCGTGTTCACTCATGAAACTCGAGTTTCATGAGTGAACACGGGAT | 2139 | chr17 | ENST00000617897.1 |
| CCL16 | AATTCAAAAAGGAGAAGTATTTCGAATATTCTCGAGAATATTCGAAATACTTCTCCT | 2140 | chr17 | ENST00000611905.1 |
| CCL16 | AATTCAAAAAGGAACTTGTCCACGGTTAAACTCGAGTTTAACCGTGGACAAGTTCCT | 2141 | chr17 | ENST00000611905.1 |
| CCL16 | AATTCAAAAACTGCCTGAAGTATTATGAGAACTCGAGTTCTCATAATACTTCAGGCAG | 2142 | chr17 | ENST00000611905.1 |
| CCL17 | AATTCAAAAAGAGAGTGAAGAATGCAGTTAACTCGAGTTAACTGCATTCTTCACTCTC | 2143 | chr16 | ENST00000219244.8 |
| CCL17 | AATTCAAAAAGAGTACTTCAAGGGAGCCATTCTCGAGAATGGCTCCCTTGAAGTACTC | 2144 | chr16 | ENST00000219244.8 |
| CCL17 | AATTCAAAAAGCAAAGCCTTGAGAGGTCTTGCTCGAGCAAGACCTCTCAAGGCTTTGC | 2145 | chr16 | ENST00000219244.8 |

TABLE 16-continued

3' to 5' (Reverse) shRNA sequences for Silencing of Cytokine/Chemokine
Genes to Reduce the Incidence of CRS

| Target Gene Symbol | shRNA Reverse Oligo Sequence | SEQ ID NO: | Location | Gene ID No. |
|---|---|---|---|---|
| CCL18 | AATTCAAAAATCTATTGTTGAGCTGCATTATCTCGAGATAATGCAGCTCAACAATAGA | 2146 | chr17 | ENST00000616054.1 |
| CCL18 | AATTCAAAAACCTTCAACTCTTCGTACATTCCTCGAGGAATGTACGAAGAGTTGAAGG | 2147 | chr17 | ENST00000616054.1 |
| CCL18 | AATTCAAAAAGTCTATACCTCCTGGCAGATTCTCGAGAATCTGCCAGGAGGTATAGAC | 2148 | chr17 | ENST00000616054.1 |
| CCL19 | AATTCAAAAAGAGTCAAGCATTGTGAATTATCTCGAGATAATTCACAATGCTTGACTC | 2149 | chr9 | ENST00000311925.6 |
| CCL19 | AATTCAAAAAGCCGCAGCAGTTAACCTATGACTCGAGTCATAGGTTAACTGCTGCGGC | 2150 | chr9 | ENST00000311925.6 |
| CCL19 | AATTCAAAAACCAACTCTGAGTGGCACCAATCTCGAGATTGGTGCCACTCAGAGTTGG | 2151 | chr9 | ENST00000311925.6 |
| CCL2 | AATTCAAAAACCCAGTCACCTGCTGTTATAACTCGAGTTATAACAGCAGGTGACTGGG | 2152 | chr17 | ENST00000225831.4 |
| CCL2 | AATTCAAAAACCCAGTCACCTGCTGTTATAACTCGAGTTATAACAGCAGGTGACTGGG | 2153 | chr17 | ENST00000225831.4 |
| CCL2 | AATTCAAAAAGCTCGCGAGCTATAGAAGAATCTCGAGATTCTTCTATAGCTCGCGAGC | 2154 | chr17 | ENST00000225831.4 |
| CCL20 | AATTCAAAAAGTTGTCTGTGTGCGCAAATCCTCGAGGATTTGCGCACACAGACAACT | 2155 | chr2 | ENST00000358813.4 |
| CCL20 | AATTCAAAAAGACCGTATTCTTCATCCTAAACTCGAGTTTAGGATGAAGAATACGGTC | 2156 | chr2 | ENST00000358813.4 |
| CCL20 | AATTCAAAAAGGGTTTAGTGCTTATCTAATCTCGAGATTAGATAAGCACTAAACCCT | 2157 | chr2 | ENST00000358813.4 |
| CCL21 | AATTCAAAAACACTCTTTCTCCTGCTTTAACCTCGAGGTTAAAGCAGGAGAAAGAGTG | 2158 | chr9 | ENST00000259607.6 |
| CCL21 | AATTCAAAAAGAGCTATGTGCAGACCCAAAGCTCGAGCTTTGGGTCTGCACATAGCTC | 2159 | chr9 | ENST00000259607.6 |
| CCL21 | AATTCAAAAACCATCCCAGCTATCCTGTTCTCTCGAGAGAACAGGATAGCTGGGATGG | 2160 | chr9 | ENST00000259607.6 |
| CCL22 | AATTCAAAAACCCTACCTCCCTGCCATTATACTCGAGTATAATGGCAGGGAGGTAGGG | 2161 | chr16 | ENST00000219235.4 |
| CCL22 | AATTCAAAAAGCGTGGTGAAACACTTCTACTCTCGAGAGTAGAAGTGTTTCACCACGC | 2162 | chr16 | ENST00000219235.4 |
| CCL22 | AATTCAAAAATGTTGCTGACACCCAGAAAGCTCGAGCTTTCTGGGTGTCAGCAACAT | 2163 | chr16 | ENST00000219235.4 |
| CCL23 | AATTCAAAAACACTCCTGGAGAGTTACTTTGCTCGAGCAAAGTAACTCTCCAGGAGTG | 2164 | chr17 | ENST00000615050.1 |
| CCL23 | AATTCAAAAACCTTTCTCATGCTGCAGGATTCTCGAGAATCCTGCAGCATGAGAAAGG | 2165 | chr17 | ENST00000615050.1 |
| CCL23 | AATTCAAAAAGAAGCTGGACACACGGATCAACTCGAGTTGATCCGTGTGTCCAGCTTC | 2166 | chr17 | ENST00000615050.1 |
| CCL24 | AATTCAAAAAAGTGATCTTCACCACCAAGAACTCGAGTTCTTGGTGGTGAAGATCACT | 2167 | chr7 | ENST00000222902.6 |
| CCL24 | AATTCAAAAAGTTCTTTGTTTCCAAGAGAATCTCGAGATTCTCTTGGAAACAAAGAAC | 2168 | chr7 | ENST00000222902.6 |
| CCL24 | AATTCAAAAACCTGCTGCATGTTCTTTGTTTCTCGAGAAACAAAGAACATGCAGCAGG | 2169 | chr7 | ENST00000222902.6 |
| CCL25 | AATTCAAAAAGCCGGATCTTTCTCCGATAAACTCGAGTTTATCGGAGAAAGATCCGGC | 2170 | chr19 | ENST00000390669.7 |
| CCL25 | AATTCAAAAAGCTCCTGGATGCTCGAAATAACTCGAGTTATTTCGAGCATCCAGGAGC | 2171 | chr19 | ENST00000390669.7 |
| CCL25 | AATTCAAAAACCCTCCTGATATCAGCTAATTCTCGAGAATTAGCTGATATCAGGAGGG | 2172 | chr19 | ENST00000390669.7 |
| CCL26 | AATTCAAAAACACACGTGGGAGTGACATATCCTCGAGGATATGTCACTCCCACGTGTG | 2173 | chr7 | ENST00000005180.8 |
| CCL26 | AATTCAAAAATCCGAAACAATTGTGACTCAGCTCGAGCTGAGTCACAATTGTTTCGGA | 2174 | chr7 | ENST00000005180.8 |
| CCL26 | AATTCAAAAAGCTGTGATATTCACTACCAAACTCGAGTTTGGTAGTGAATATCACAGC | 2175 | chr7 | ENST00000005180.8 |
| CCL27 | AATTCAAAAATTCGTGCTTCACCTGGCTCAACTCGAGTTGAGCCAGGTGAAGCACGAA | 2176 | chr9 | ENST00000259631.4 |
| CCL27 | AATTCAAAAACCGAAAGCCACTCTCAGACAACTCGAGTTGTCTGAGAGTGGCTTTCGG | 2177 | chr9 | ENST00000259631.4 |
| CCL27 | AATTCAAAAACAAGCTACTGAGGAAGGTCATCTCGAGATGACCTTCCTCAGTAGCTTG | 2178 | chr9 | ENST00000259631.4 |
| CCL28 | AATTCAAAAACGGAGGTTTCACATCATATTTCTCGAGAAATATGATGTGAAACCTCCG | 2179 | chr5 | ENST00000361115.4 |
| CCL28 | AATTCAAAAACACGAAACATACGGCCATAAACTCGAGTTTATGGCCGTATGTTTCGTG | 2180 | chr5 | ENST00000361115.4 |
| CCL28 | AATTCAAAAATTAGAGAGTCTACAGATAAATCTCGAGATTTATCTGTAGACTCTCTAA | 2181 | chr5 | ENST00000361115.4 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| CCL3 | AATTCAAAAACCGGCAGATTCCACAGAATTTCTCGAGAAATTCTGTGGAATCTGCCGG | 2182 | chr17 | ENST00000613922.1 |
| CCL3 | AATTCAAAAATTCGATTTCACAGTGTGTTTGCTCGAGCAAACACACTGTGAAATCGAA | 2183 | chr17 | ENST00000613922.1 |
| CCL3 | AATTCAAAAACAACCAGTTCTCTGCATCACTCTCGAGAGTGATGCAGAGAACTGGTTG | 2184 | chr17 | ENST00000613922.1 |
| CCL4 | AATTCAAAAATGTGCCGTGTTATTGTATTACTCGAGTAATACAATAACACGGCACAT | 2185 | chr17 | ENST00000615863.1 |
| CCL4 | AATTCAAAAATCCTGTCCCTTCTCTTAATTTCTCGAGAAATTAAGAGAAGGGACAGGA | 2186 | chr17 | ENST00000615863.1 |
| CCL4 | AATTCAAAAACTGTGCTGATCCCAGTGAATCCTCGAGGATTCACTGGGATCAGCACAG | 2187 | chr17 | ENST00000615863.1 |
| CCL5 | AATTCAAAAATGAACCTGAACTTACACAAATCTCGAGATTTGTGTAAGTTCAGGTTCA | 2188 | chr17 | ENST00000603197.5 |
| CCL5 | AATTCAAAAACCTGCTGCTTTGCCTACATTGCTCGAGCAATGTAGGCAAAGCAGCAGG | 2189 | chr17 | ENST00000603197.5 |
| CCL5 | AATTCAAAAACTACCACACAGCAGCAGTTACCTCGAGGTAACTGCTGCTGTGTGGTAG | 2190 | chr17 | ENST00000603197.5 |
| CCL7 | AATTCAAAAACATAAAGCCTTGGATGTATATCTCGAGATATACATCCAAGGCTTTATG | 2191 | chr17 | ENST00000378569.2 |
| CCL7 | AATTCAAAAAGCTGCTACAGATTTATCAATACTCGAGTATTGATAAATCTGTAGCAGC | 2192 | chr17 | ENST00000378569.2 |
| CCL7 | AATTCAAAAATCTAAGGAATATGAGCTTTATCTCGAGATAAAGCTCATATTCCTTAGA | 2193 | chr17 | ENST00000378569.2 |
| CCL8 | AATTCAAAAAGCTGCTTTAACGTGATCAATACTCGAGTATTGATCACGTTAAAGCAGC | 2194 | chr17 | ENST00000394620.1 |
| CCL8 | AATTCAAAAACAGGTGCAGTGTGACATTATTCTCGAGAATAATGTCACACTGCACCTG | 2195 | chr17 | ENST00000394620.1 |
| CCL8 | AATTCAAAAATTGTACTGCTGTTGTTGAAATCTCGAGATTTCAACAACAGCAGTACAA | 2196 | chr17 | ENST00000394620.1 |
| CCR1 | AATTCAAAAAATTCTGCTAAGACGACCAAATCTCGAGATTTGGTCGTCTTAGCAGAAT | 2197 | chr3 | ENST00000296140.3 |
| CCR1 | AATTCAAAAAATCTGCTACACAGGGATTATACTCGAGTATAATCCCTGTGTAGCAGAT | 2198 | chr3 | ENST00000296140.3 |
| CCR1 | AATTCAAAAACCTCTGTACTCCTTGGTATTTCTCGAGAAATACCAAGGAGTACAGAGG | 2199 | chr3 | ENST00000296140.3 |
| CCR2 | AATTCAAAAACGGTGCTCCCTGTCATAAATCTCGAGATTTATGACAGGGAGCACCGT | 2200 | chr3 | ENST00000445132.2 |
| CCR2 | AATTCAAAAACTTCTGGACTCCCTATAATATCTCGAGATATTATAGGGAGTCCAGAAG | 2201 | chr3 | ENST00000445132.2 |
| CCR2 | AATTCAAAAAGCTGTATCACATCGGTTATTTCTCGAGAAATAACCGATGTGATACAGC | 2202 | chr3 | ENST00000445132.2 |
| CCR3 | AATTCAAAAAATACAGGAGGCTCCGAATTATCTCGAGATAATTCGGAGCCTCCTGTAT | 2203 | chr3 | ENST00000357422.2 |
| CCR3 | AATTCAAAAACCCAGAGGATACAGTATATAGCTCGAGCTATATACTGTATCCTCTGGG | 2204 | chr3 | ENST00000357422.2 |
| CCR3 | AATTCAAAAATAGCAGCTCTTCCTGAATTTACTCGAGTAAATTCAGGAAGAGCTGCTA | 2205 | chr3 | ENST00000357422.2 |
| CCR5 | AATTCAAAAAACTCTTGACAGGGCTCTATTTCTCGAGAAATAGAGCCCTGTCAAGAGT | 2206 | chr3 | ENST00000292303.4 |
| CCR5 | AATTCAAAAACGAGCGAGCAAGCTCAGTTTACTCGAGTAAACTGAGCTTGCTCGCTCG | 2207 | chr3 | ENST00000292303.4 |
| CCR5 | AATTCAAAAATCCATACAGTCAGTATCAATTCTCGAGAATTGATACTGACTGTATGGA | 2208 | chr3 | ENST00000292303.4 |
| CCR6 | AATTCAAAAAGGTCTATGACAGACGTCTATCCTCGAGGATAGACGTCTGTCATAGACC | 2209 | chr6 | ENST00000341935.9 |
| CCR6 | AATTCAAAAACGACTCCAGTGAAGATTATTTCTCGAGAAATAATCTTCACTGGAGTCG | 2210 | chr6 | ENST00000341935.9 |
| CCR6 | AATTCAAAAATCGACTCCAGTGAAGATTATTCTCGAGAATAATCTTCACTGGAGTCGA | 2211 | chr6 | ENST00000341935.9 |
| CCR7 | AATTCAAAAAGATGAGGTCACGGACGATTACCTCGAGGTAATCGTCCGTGACCTCATC | 2212 | chr17 | ENST00000246657.2 |
| CCR7 | AATTCAAAAAGCTGGTCGTGTTGACCTATATCTCGAGATATAGGTCAACACGACCAGC | 2213 | chr17 | ENST00000246657.2 |
| CCR7 | AATTCAAAAACGTGTTGACCTATATCTATTTCTCGAGAAATAGATATAGGTCAACACG | 2214 | chr17 | ENST00000246657.2 |
| CD109 | AATTCAAAAAGCCGATCCTTACATAGATATTCTCGAGAATATCTATGTAAGGATCGGC | 2215 | chr6 | ENST00000287097.5 |
| CD109 | AATTCAAAAACCCGGAGGAAATGTGACTATTCTCGAGAATAGTCACATTTCCTCCGGG | 2216 | chr6 | ENST00000287097.5 |
| CD109 | AATTCAAAAACCGCTTATCATTTGAGACCAACTCGAGTTGGTCTCAAATGATAAGCGG | 2217 | chr6 | ENST00000287097.5 |
| CD27 | AATTCAAAAACTTACCTTATGTCAGTGAGATCTCGAGATCTCACTGACATAAGGTAAG | 2218 | chr12 | ENST00000266557.3 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| CD27 | AATTCAAAAAGCACTGTAACTCTGGTCTTCTCTCGAGAGAAGACCAGAGTTACAGTGC | 2219 | chr12 | ENST00000266557.3 |
| CD27 | AATTCAAAAACCACCCACTTACCTTATGTCACTCGAGTGACATAAGGTAAGTGGGTGG | 2220 | chr12 | ENST00000266557.3 |
| CD27 | AATTCAAAAAGCCAGATGTGTGAGCCAGGAACTCGAGTTCCTGGCTCACACATCTGGC | 2221 | chr12 | ENST00000266557.3 |
| CD28 | AATTCAAAAACCTCCAGAATTTGTATGTTAACTCGAGTTAACATACAAATTCTGGAGG | 2222 | ch2 | ENST00000458610.6 |
| CD28 | AATTCAAAAACAACCTTAGCTGCAAGTATTCCTCGAGGAATACTTGCAGCTAAGGTTG | 2223 | ch2 | ENST00000458610.6 |
| CD28 | AATTCAAAAATGGAGTCCTGGCTTGCTATAGCTCGAGCTATAGCAAGCCAGGACTCCA | 2224 | ch2 | ENST00000458610.6 |
| CD28 | AATTCAAAAACCTCCTCCTTACCTAGACAATCTCGAGATTGTCTAGGTAAGGAGGAGG | 2225 | ch2 | ENST00000458610.6 |
| CD36 | AATTCAAAAAAGAACCTATTGATGGATTAAACTCGAGTTTAATCCATCAATAGGTTCT | 2226 | chr7 | ENST00000309881.11 |
| CD36 | AATTCAAAAAGCCATAATCGACACATATAAACTCGAGTTTATATGTGTCGATTATGGC | 2227 | chr7 | ENST00000309881.11 |
| CD36 | AATTCAAAAAACGGCTGCAGGTCAACCTATTCTCGAGAATAGGTTGACCTGCAGCCGT | 2228 | chr7 | ENST00000309881.11 |
| CD4 | AATTCAAAAACCTGATCATCAAGAATCTTAACTCGAGTTAAGATTCTTGATGATCAGG | 2229 | chr12 | ENST00000011653.8 |
| CD4 | AATTCAAAAAAGAGCGGATGTCTCAGATCAACTCGAGTTGATCTGAGACATCCGCTCT | 2230 | chr12 | ENST00000011653.8 |
| CD4 | AATTCAAAAACCACTCGCCTTTACAGTTGAACTCGAGTTCAACTGTAAAGGCGAGTGG | 2231 | chr12 | ENST00000011653.8 |
| CD40LG | AATTCAAAAAGGGAAACAGCTGACCGTTAAACTCGAGTTTAACGGTCAGCTGTTTCCC | 2232 | chrX | ENST00000370629.6 |
| CD40LG | AATTCAAAAATTCGAGTCAAGCTCCATTTATCTCGAGATAAATGGAGCTTGACTCGAA | 2233 | chrX | ENST00000370629.6 |
| CD40LG | AATTCAAAAATGACGCTGGGAGTCTTCATAACTCGAGTTATGAAGACTCCCAGCGTCA | 2234 | chrX | ENST00000370629.6 |
| CD70 | AATTCAAAAACCATCGTGATGGCATCTACATCTCGAGATGTAGATGCCATCACGATGG | 2235 | chr19 | ENST00000245903.3 |
| CD70 | AATTCAAAAACAGCTACGTATCCATCGTGATCTCGAGATCACGATGGATACGTAGCTG | 2236 | chr19 | ENST00000245903.3 |
| CD70 | AATTCAAAAACCAACCTCACTGGGACACTTTCTCGAGAAAGTGTCCCAGTGAGGTTGG | 2237 | chr19 | ENST00000245903.3 |
| CD74 | AATTCAAAAACAAGTCGGAACAGCAGATAACCTCGAGGTTATCTGCTGTTCCGACTTG | 2238 | chr5 | ENST00000009530.11 |
| CD74 | AATTCAAAAAGAGAACCTGAGACACCTTAAGCTCGAGCTTAAGGTGTCTCAGGTTCTC | 2239 | chr5 | ENST00000009530.11 |
| CD74 | AATTCAAAAACCACACAGCTACAGCTTTCTTCTCGAGAAGAAAGCTGTAGCTGTGTGG | 2240 | chr5 | ENST00000009530.11 |
| CD8A | AATTCAAAAAGCTGGACTTCGCCTGTGATATCTCGAGATATCACAGGCGAAGTCCAGC | 2241 | ch2 | ENST00000409511.6 |
| CD8A | AATTCAAAAAGTGTATTCATTCTCATGATTACTCGAGTAATCATGAGAATGAATACAC | 2242 | ch2 | ENST00000409511.6 |
| CD8A | AATTCAAAAACCAGAGACAGCTTGATCAAAGCTCGAGCTTTGATCAAGCTGTCTCTGG | 2243 | ch2 | ENST00000409511.6 |
| CD8A | AATTCAAAAACCTTCTCCTGTCACTGGTTATCTCGAGATAACCAGTGACAGGAGAAGG | 2244 | ch2 | ENST00000409511.6 |
| CER1 | AATTCAAAAAGAGAAGATGCTGTCCAGATTTCTCGAGAAATCTGGACAGCATCTTCTC | 2245 | chr9 | ENST00000380911.3 |
| CER1 | AATTCAAAAACCAGCCGATAGATGGAATGAACTCGAGTTCATTCCATCTATCGGCTGG | 2246 | chr9 | ENST00000380911.3 |
| CER1 | AATTCAAAAACAAGAAATTCTGGCACCACTTCTCGAGAAGTGGTGCCAGAATTTCTTG | 2247 | chr9 | ENST00000380911.3 |
| CHRD | AATTCAAAAACGTCCTGCAAAGTGTCCTTTCTCGAGAAAGGACACTTTGCAGGACGT | 2248 | chr3 | ENST00000204604.5 |
| CHRD | AATTCAAAAACTGATCCAGAGCTGGAGAAACTCGAGTTTCTCCAGCTCTGGATCAGT | 2249 | chr3 | ENST00000204604.5 |
| CHRD | AATTCAAAAACGGCTGCTGAAGGGATTCTATCTCGAGATAGAATCCCTTCAGCAGCCG | 2250 | chr3 | ENST00000204604.5 |
| CKLF | AATTCAAAAACCTTTGCTTGTGTTTGCACTTCTCGAGAAGTGCAAACACAAGCAAAGG | 2251 | chr16 | ENST00000264001.8 |
| CKLF | AATTCAAAAACCCTGAACCATATATTGTTATCTCGAGATAACAATATATGGTTCAGGG | 2252 | chr16 | ENST00000264001.8 |
| CKLF | AATTCAAAAATGGATTTGAAGTCACCGTTATCTCGAGATAACGGTGACTTCAAATCCA | 2253 | chr16 | ENST00000264001.8 |
| CLCF1 | AATTCAAAAAGAAACAAACATGGTGGCAATTCTCGAGAATTGCCACCATGTTTGTTTC | 2254 | chr11 | ENST00000312438.7 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| CLCF1 | AATTCAAAAACCACAGGATTTCCTGAAAGTTCTCGAGAACTTTCAGGAAATCCTGTGG | 2255 | chr11 | ENST00000312438.7 |
| CLCF1 | AATTCAAAAACATGGTGGCAATTCTACACAACTCGAGTTGTGTAGAATTGCCACCATG | 2256 | chr11 | ENST00000312438.7 |
| CMTM1 | AATTCAAAAACACCACTTGCTGACCTATTTACTCGAGTAAATAGGTCAGCAAGTGGTG | 2257 | chr16 | ENST00000379500.6 |
| CMTM1 | AATTCAAAAAGACCTATTTACATTGGCCCTTCTCGAGAAGGGCCAATGTAAATAGGTC | 2258 | chr16 | ENST00000379500.6 |
| CMTM1 | AATTCAAAAAGCTGTGTTCCTTTCAGTAGTTCTCGAGAACTACTGAAAGGAACACAGC | 2259 | chr16 | ENST00000379500.6 |
| CMTM2 | AATTCAAAAAGTAAGGAGCCATCGGACAAACCTCGAGGTTTGTCCGATGGCTCCTTAC | 2260 | chr16 | ENST00000268595.2 |
| CMTM2 | AATTCAAAAACTTACTTGCTGTGATCCTTATCTCGAGATAAGGATCACAGCAAGTAAG | 2261 | chr16 | ENST00000268595.2 |
| CMTM2 | AATTCAAAAACATAAGGAGCCATCGGACAAACTCGAGTTTGTCCGATGGCTCCTTATG | 2262 | chr16 | ENST00000268595.2 |
| CMTM3 | AATTCAAAAACATCGTGTTTGCAACTGATTTCTCGAGAAATCAGTTGCAAACACGATG | 2263 | chr16 | ENST00000361909.8 |
| CMTM3 | AATTCAAAAAGCTTCTTAACAGATGGCATTTCTCGAGAAATGCCATCTGTTAAGAAGC | 2264 | chr16 | ENST00000361909.8 |
| CMTM3 | AATTCAAAAAGCTTCTTAACAGATGGCATTTCTCGAGAAATGCCATCTGTTAAGAAGC | 2265 | chr16 | ENST00000361909.8 |
| CMTM4 | AATTCAAAAACAACTGGAATCTGACAGATTTCTCGAGAAATCTGTCAGATTCCAGTTG | 2266 | chr16 | ENST00000394106.6 |
| CMTM4 | AATTCAAAAAGACTGGCGTCTTGCTGATTATCTCGAGATAATCAGCAAGACGCCAGTC | 2267 | chr16 | ENST00000394106.6 |
| CMTM4 | AATTCAAAAAGCAGAAATTGCTGCCGTGATACTCGAGTATCACGGCAGCAATTTCTGC | 2268 | chr16 | ENST00000394106.6 |
| CMTM5 | AATTCAAAAACAAGATCTACCGGACTGAGATCTCGAGATCTCAGTCCGGTAGATCTTG | 2269 | chr14 | ENST00000359320.7 |
| CMTM5 | AATTCAAAAACCTGACCCTCATCATCTTCATCTCGAGATGAAGATGATGAGGGTCAGG | 2270 | chr14 | ENST00000359320.7 |
| CMTM5 | AATTCAAAAACTTCCTCTATGCCACCCAGTACTCGAGTACTGGGTGGCATAGAGGAAG | 2271 | chr14 | ENST00000359320.7 |
| CMTM6 | AATTCAAAAAGCCCTCACTGAGCCACTTAATCTCGAGATTAAGTGGCTCAGTGAGGGC | 2272 | chr3 | ENST00000205636.3 |
| CMTM6 | AATTCAAAAACCCAAGACAGTGAAAGTAATTCTCGAGAATTACTTTCACTGTCTTGGG | 2273 | chr3 | ENST00000205636.3 |
| CMTM6 | AATTCAAAAACCCAAGACAGTGAAAGTAATTCTCGAGAATTACTTTCACTGTCTTGGG | 2274 | chr3 | ENST00000205636.3 |
| CMTM7 | AATTCAAAAACTGCTGAAAGTGGCGCAAATGCTCGAGCATTTGCGCCACTTTCAGCAG | 2275 | chr3 | ENST00000334983.9 |
| CMTM7 | AATTCAAAAACAAAGCCCTGTCCTAATTTATCTCGAGATAAATTAGGACAGGGCTTTG | 2276 | chr3 | ENST00000334983.9 |
| CMTM7 | AATTCAAAAACCTGTCGATCTTTGGTTTCATCTCGAGATGAAACCAAAGATCGACAGG | 2277 | chr3 | ENST00000334983.9 |
| CMTM8 | AATTCAAAAATGCTGGTATGGACGCTTATTGCTCGAGCAATAAGCGTCCATACCAGCA | 2278 | chr3 | ENST00000307526.3 |
| CMTM8 | AATTCAAAAAGCAAAGTGTTGTAGCTTATAACTCGAGTTATAAGCTACAACACTTTGC | 2279 | chr3 | ENST00000307526.3 |
| CMTM8 | AATTCAAAAAATATTCCCAGAGAATTGTATTCTCGAGAATACAATTCTCTGGGAATAT | 2280 | chr3 | ENST00000307526.3 |
| CNTF | AATTCAAAAAGTAACCTCTACAGGCATTTAACTCGAGTTAAATGCCTGTAGAGGTTAC | 2281 | chr11 | ENST00000361987.5 |
| CNTF | AATTCAAAAAGTTGAAGGACTACAGGTATTTCTCGAGAAATACCTGTAGTCCTTCAAC | 2282 | chr11 | ENST00000361987.5 |
| CNTF | AATTCAAAAAGGTGACTTCCATCAAGCTATACTCGAGTATAGCTTGATGGAAGTCACC | 2283 | chr11 | ENST00000361987.5 |
| CNTFR | AATTCAAAAACATTCTCTTCAGACACAATTTCTCGAGAAATTGTGTCTGAAGAGAATG | 2284 | chr9 | ENST00000351266.8 |
| CNTFR | AATTCAAAAAGCATTCTCTTCAGACACAATTCTCGAGAATTGTGTCTGAAGAGAATGC | 2285 | chr9 | ENST00000351266.8 |
| CNTFR | AATTCAAAAAGCCGGGAAGGAGTACATTATCCTCGAGGATAATGTACTCCTTCCCGGC | 2286 | chr9 | ENST00000351266.8 |
| COPS5 | AATTCAAAAACTAAGGATCACCATTACTTTACTCGAGTAAAGTAATGGTGATCCTTAG | 2287 | chr8 | ENST00000357849.8 |
| COPS5 | AATTCAAAAACCAGACTATTCCACTTAATAACTCGAGTTATTAAGTGGAATAGTCTGG | 2288 | chr8 | ENST00000357849.8 |
| COPS5 | AATTCAAAAACAGTCTCTGAGAAGTACTTTACTCGAGTAAAGTACTTCTCAGAGACTG | 2289 | chr8 | ENST00000357849.8 |
| CRLF1 | AATTCAAAAACGATGTACTCACGCTGGATATCTCGAGATATCCAGCGTGAGTACATCG | 2290 | chr19 | ENST00000392386.7 |
| CRLF1 | AATTCAAAAACGATGTACTCACGCTGGATATCTCGAGATATCCAGCGTGAGTACATCG | 2291 | chr19 | ENST00000392386.7 |

TABLE 16-continued

3' to 5' (Reverse) shRNA sequences for Silencing of Cytokine/Chemokine
Genes to Reduce the Incidence of CRS

| Target Gene Symbol | shRNA Reverse Oligo Sequence | SEQ ID NO: | Location | Gene ID No. |
|---|---|---|---|---|
| CRLF1 | AATTCAAAAACCCAGAGAAACCCGTCAACATCTCGAGATGTTGACGGGTTTCTCTGGG | 2292 | chr19 | ENST00000392386.7 |
| CSF1 | AATTCAAAAATCTCCTGGTACAAGACATAATCTCGAGATTATGTCTTGTACCAGGAGA | 2293 | chr1 | ENST00000329608.10 |
| CSF1 | AATTCAAAAAGTCGGCCTGATTTCCCGTAAACTCGAGTTTACGGGAAATCAGGCCGAC | 2294 | chr1 | ENST00000329608.10 |
| CSF1 | AATTCAAAAATTGACAAGGACTGGAATATTTCTCGAGAAATATTCCAGTCCTTGTCAA | 2295 | chr1 | ENST00000329608.10 |
| CSF1R | AATTCAAAAAGTGAACAGCAAGTTCTATAAACTCGAGTTTATAGAACTTGCTGTTCAC | 2296 | chr5 | ENST00000286301.7 |
| CSF1R | AATTCAAAAACAGGAGAGAGCGGGACTATACTCGAGTATAGTCCCGCTCTCTCCTGT | 2297 | chr5 | ENST00000286301.7 |
| CSF1R | AATTCAAAAAGCTGCTATTGTACAAGTATAACTCGAGTTATACTTGTACAATAGCAGC | 2298 | chr5 | ENST00000286301.7 |
| CSF2 | AATTCAAAAAGGAGCTGCTCTCTCATGAAACCTCGAGGTTTCATGAGAGAGCAGCTCC | 2299 | chr5 | ENST00000296871.3 |
| CSF2 | AATTCAAAAACCCAGATTATCACCTTTGAAACTCGAGTTTCAAAGGTGATAATCTGGG | 2300 | chr5 | ENST00000296871.3 |
| CSF2 | AATTCAAAAAGAAGTCATCTCAGAAATGTTTCTCGAGAAACATTTCTGAGATGACTTC | 2301 | chr5 | ENST00000296871.3 |
| CSF3 | AATTCAAAAAGTCTATTTAAGCCTCATATTTCTCGAGAAATATGAGGCTTAAATAGAC | 2302 | chr17 | ENST00000225474.6 |
| CSF3 | AATTCAAAAAGATAGGTAAATACCAAGTATTCTCGAGAATACTTGGTATTTACCTATC | 2303 | chr17 | ENST00000225474.6 |
| CSF3 | AATTCAAAAAGCTTAGAGCAAGTGAGGAAGACTCGAGTCTTCCTCACTTGCTCTAAGC | 2304 | chr17 | ENST00000225474.6 |
| CSF3R | AATTCAAAAACAGCCAGGCCTGCACATAAATCTCGAGATTTATGTGCAGGCCTGGCTG | 2305 | chr1 | ENST00000361632.8 |
| CSF3R | AATTCAAAAACTATGCCTACTCTCAAGAAATCTCGAGATTTCTTGAGAGTAGGCATAG | 2306 | chr1 | ENST00000361632.8 |
| CSF3R | AATTCAAAAACCAGCTTCACTCTGAAGAGTTCTCGAGAACTCTTCAGAGTGAAGCTGG | 2307 | chr1 | ENST00000361632.8 |
| CTF1 | AATTCAAAAAGAGCAGCTGCTCCAGGAATATCTCGAGATATTCCTGGAGCAGCTGCTC | 2308 | chr16 | ENST00000279804.2 |
| CTF1 | AATTCAAAAAGTCTCTCCTTCCGCTTCTTTGCTCGAGCAAAGAAGCGGAAGGAGAGAC | 2309 | chr16 | ENST00000279804.2 |
| CTF1 | AATTCAAAAATGTCTGTCTGTCGCTCTTAGCTCGAGCTAAGAGCAGACAGACAGACA | 2310 | chr16 | ENST00000279804.2 |
| CX3CL1 | AATTCAAAAACCCGGAGCTGTGGTAGTAATTCTCGAGAATTACTACCACAGCTCCGGG | 2311 | chr16 | ENST00000006053.6 |
| CX3CL1 | AATTCAAAAAGCTGCTGCCCTAACTCGAAATCTCGAGATTTCGAGTTAGGGCAGCAGC | 2312 | chr16 | ENST00000006053.6 |
| CX3CL1 | AATTCAAAAACGGTGTGACGAAATGCAACATCTCGAGATGTTGCATTTCGTCACACCG | 2313 | chr16 | ENST00000006053.6 |
| CX3CR1 | AATTCAAAAATGGCCTGTGTCTAGTTGTTTGCTCGAGCAAACAACTAGACACAGGCCA | 2314 | chr3 | ENST00000399220.2 |
| CX3CR1 | AATTCAAAAATGGGATCCCTCATCCTCATACCTCGAGGTATGAGGATGAGGGATCCCA | 2315 | chr3 | ENST00000399220.2 |
| CX3CR1 | AATTCAAAAAGCTTTGCTCATCCACTATCAACTCGAGTTGATAGTGGATGAGCAAAGC | 2316 | chr3 | ENST00000399220.2 |
| CXCL1 | AATTCAAAAACCTGCACACTGTCCTATTATCTCGAGATAATAGGACAGTGTGCAGGT | 2317 | chr4 | ENST00000395761.3 |
| CXCL1 | AATTCAAAAAGATGCTGAACAGTGACAAATCTCGAGATTTGTCACTGTTCAGCATCT | 2318 | chr4 | ENST00000395761.3 |
| CXCL1 | AATTCAAAAAGTTCTCCAGTCATTATGTTAACTCGAGTTAACATAATGACTGGAGAAC | 2319 | chr4 | ENST00000395761.3 |
| CXCL10 | AATTCAAAAAGTATATGTCAAGCCATAATTGCTCGAGCAATTATGGCTTGACATATAC | 2320 | chr4 | ENST00000306602.2 |
| CXCL10 | AATTCAAAAACTCTACCCTGGCACTATAATCTCGAGATTATAGTGCCAGGGTAGAGT | 2321 | chr4 | ENST00000306602.2 |
| CXCL10 | AATTCAAAAACCTGTTAATCCAAGGTCTTTACTCGAGTAAAGACCTTGGATTAACAGG | 2322 | chr4 | ENST00000306602.2 |
| CXCL11 | AATTCAAAAAGCTGGTTACCATCGGAGTTTACTCGAGTAAACTCCGATGGTAACCAGC | 2323 | chr4 | ENST00000306621.7 |
| CXCL11 | AATTCAAAAAGCAGTGAAAGTGGCAGATATTCTCGAGAATATCTGCCACTTTCACTGC | 2324 | chr4 | ENST00000306621.7 |
| CXCL11 | AATTCAAAAAGAAGCAAGCAAGGCTTATAATCTCGAGATTATAAGCCTTGCTTGCTTC | 2325 | chr4 | ENST00000306621.7 |
| CXCL12 | AATTCAAAAAGCTTAGACTAAGGCCATTATTCTCGAGAATAATGGCCTTAGTCTAAGC | 2326 | chr10 | ENST00000343575.10 |
| CXCL12 | AATTCAAAAACTCTCACTATACCAGTATAATCTCGAGATTATACTGGTATAGTGAGAG | 2327 | chr10 | ENST00000343575.10 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| CXCL12 | AATTCAAAAACAAACTGTGCCCTTCAGATTGCTCGAGCAATCTGAAGGGCACAGTTTG | 2328 | chr10 | ENST00000343575.10 |
| CXCL13 | AATTCAAAAAGATTCCCTGATGCTGATATTTCTCGAGAAATATCAGCATCAGGGAATC | 2329 | chr4 | ENST00000286758.4 |
| CXCL13 | AATTCAAAAAGGAATCCATGTAGTAGATATCTCGAGATATCTACTACATGGATTCCT | 2330 | chr4 | ENST00000286758.4 |
| CXCL13 | AATTCAAAAAGGTGTTCTGGAGGTCTATTACTCGAGTAATAGACCTCCAGAACACCT | 2331 | chr4 | ENST00000286758.4 |
| CXCL14 | AATTCAAAAATTTGTCCATACGTCACTATACTCGAGTATAGTGACGTATGGACAAAT | 2332 | chr5 | ENST00000337225.5 |
| CXCL14 | AATTCAAAAACAAAGGACTTTGCAGATTAAACTCGAGTTTAATCTGCAAAGTCCTTTG | 2333 | chr5 | ENST00000337225.5 |
| CXCL14 | AATTCAAAAAGCGCAGGGTCTACGAAGAATACTCGAGTATTCTTCGTAGACCCTGCGC | 2334 | chr5 | ENST00000337225.5 |
| CXCL16 | AATTCAAAAACATCCAGCCTACACGTATTTCTCGAGAAATACGTGTAGGCTGGATGT | 2335 | chr17 | ENST00000293778.10 |
| CXCL16 | AATTCAAAAATCTGAAGGTGCGAGGATTATACTCGAGTATAATCCTCGCACCTTCAGA | 2336 | chr17 | ENST00000293778.10 |
| CXCL16 | AATTCAAAAATCCAGATCTGCCGGTTCATTACTCGAGTAATGAACCGGCAGATCTGGA | 2337 | chr17 | ENST00000293778.10 |
| CXCL17 | AATTCAAAAAGCGCCCACTCTTCCAATTAAACTCGAGTTTAATTGGAAGAGTGGGCGC | 2338 | chr19 | ENST00000601181.5 |
| CXCL17 | AATTCAAAAATCCAGAGCCTGCCAGCAATTTCTCGAGAAATTGCTGGCAGGCTCTGGA | 2339 | chr19 | ENST00000601181.5 |
| CXCL17 | AATTCAAAAAGAATGTGAGTGCAAAGATTGCTCGAGCAATCTTTGCACTCACATTCT | 2340 | chr19 | ENST00000601181.5 |
| CXCL2 | AATTCAAAAACTTGCACACTCTCCCATTATACTCGAGTATAATGGGAGAGTGTGCAAG | 2341 | chr4 | ENST00000508487.2 |
| CXCL2 | AATTCAAAAAGCAGATATTCTCTAGTCATTTCTCGAGAAATGACTAGAGAATATCTGC | 2342 | chr4 | ENST00000508487.2 |
| CXCL2 | AATTCAAAAAATTTCTTCGTGATGACATATCCTCGAGGATATGTCATCACGAAGAAAT | 2343 | chr4 | ENST00000508487.2 |
| CXCL3 | AATTCAAAAATTACGAGGGTTCTACTTATTTCTCGAGAAATAAGTAGAACCCTCGTAA | 2344 | chr4 | ENST00000296026.4 |
| CXCL3 | AATTCAAAAAATTTAGTGGGAGACCATAATGCTCGAGCATTATGGTCTCCCACTAAAT | 2345 | chr4 | ENST00000296026.4 |
| CXCL3 | AATTCAAAAAACTGACAGGAGAGAAGTAAGACTCGAGTCTTACTTCTCTCCTGTCAGT | 2346 | chr4 | ENST00000296026.4 |
| CXCL5 | AATTCAAAAATGAATTGTAGGTGACTATTATCTCGAGATAATAGTCACCTACAATTCA | 2347 | chr4 | ENST00000296027.4 |
| CXCL5 | AATTCAAAAACAGACCACGCAAGGAGTTCATCTCGAGATGAACTCCTTGCGTGGTCTG | 2348 | chr4 | ENST00000296027.4 |
| CXCL5 | AATTCAAAAACGGGAAGGAAATTTGTCTTGACTCGAGTCAAGACAAATTTCCTTCCCG | 2349 | chr4 | ENST00000296027.4 |
| CXCL6 | AATTCAAAAATTTACCCTAGGATGCTATTTACTCGAGTAAATAGCATCCTAGGGTAAA | 2350 | chr4 | ENST00000226317.9 |
| CXCL6 | AATTCAAAAAGTTGCACTTGTTTACGCGTTACTCGAGTAACGCGTAAACAAGTGCAAC | 2351 | chr4 | ENST00000226317.9 |
| CXCL6 | AATTCAAAAAGCTGTGGATTTCGTATGGAAACTCGAGTTTCCATACGAAATCCACAGC | 2352 | chr4 | ENST00000226317.9 |
| CXCL8 | AATTCAAAAATGCGCCAACACAGAAATTATTCTCGAGAATAATTTCTGTGTTGGCGCA | 2353 | chr4 | ENST00000307407.7 |
| CXCL8 | AATTCAAAAACAAGAGAATATCCGAACTTTACTCGAGTAAAGTTCGGATATTCTCTTG | 2354 | chr4 | ENST00000307407.7 |
| CXCL8 | AATTCAAAAATGCACGGGAGAATATACAAATCTCGAGATTTGTATATTCTCCCGTGCA | 2355 | chr4 | ENST00000307407.7 |
| CXCL9 | AATTCAAAAACCAAAGGAGGATGGCATATAACTCGAGTTATATGCCATCCTCCTTTGG | 2356 | chr4 | ENST00000264888.5 |
| CXCL9 | AATTCAAAAACCAAACGTTAAGAATTGTTAACTCGAGTTAACAATTCTTAACGTTTGG | 2357 | chr4 | ENST00000264888.5 |
| CXCL9 | AATTCAAAAAGATGTGAAGGAACTGATTAAACTCGAGTTTAATCAGTTCCTTCACATC | 2358 | chr4 | ENST00000264888.5 |
| CXCR1 | AATTCAAAAACTTGGCACGTCATCGTGTTACCTCGAGGTAACACGATGACGTGCCAAG | 2359 | chr2 | ENST00000295683.2 |
| CXCR1 | AATTCAAAAACCCACTAACTGGCTAATTAGCTCGAGCTAATTAGCCAGTTAGTGGGT | 2360 | chr2 | ENST00000295683.2 |
| CXCR1 | AATTCAAAAAGAGACACTCAACAAGTATGTTCTCGAGAACATACTTGTTGAGTGTCTC | 2361 | chr2 | ENST00000295683.2 |
| CXCR2 | AATTCAAAAAGAAGCGCTACTTGGTCAAATTCTCGAGAATTTGACCAAGTAGCGCTTC | 2362 | chr2 | ENST00000318507.6 |
| CXCR2 | AATTCAAAAAGCCACTAAATTGACACTTAAACTCGAGTTTAAGTGTCAATTTAGTGGC | 2363 | chr2 | ENST00000318507.6 |
| CXCR2 | AATTCAAAAACCCTGGAAATCAACAAGTATTCTCGAGAATACTTGTTGATTTCCAGGG | 2364 | chr2 | ENST00000318507.6 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| CXCR3 | AATTCAAAAACCTTCTCATTTGGAAACTAAACTCGAGTTTAGTTTCCAAATGAGAAGG | 2365 | chrX | ENST00000373693.3 |
| CXCR3 | AATTCAAAAACGCTACCTGAACATAGTTCATCTCGAGATGAACTATGTTCAGGTAGCG | 2366 | chrX | ENST00000373693.3 |
| CXCR3 | AATTCAAAAAGAGTACAAGGCATGGCGTAGACTCGAGTCTACGCCATGCCTTGTACTC | 2367 | chrX | ENST00000373693.3 |
| CXCR4 | AATTCAAAAACTATTCCCGACTTCATCTTTGCTCGAGCAAAGATGAAGTCGGGAATAG | 2368 | chr2 | ENST00000409817.1 |
| CXCR4 | AATTCAAAAAGCGTGTAGTGAATCACGTAAACTCGAGTTTACGTGATTCACTACACGC | 2369 | chr2 | ENST00000409817.1 |
| CXCR4 | AATTCAAAAACCTGTTCTTAAGACGTGATTTCTCGAGAAATCACGTCTTAAGAACAGG | 2370 | chr2 | ENST00000409817.1 |
| CXCR6 | AATTCAAAAAGCTTGCTCATCTGGGTGATATCTCGAGATATCACCCAGATGAGCAAGC | 2371 | chr3 | ENST00000304552.4 |
| CXCR6 | AATTCAAAAATACTGGGCATCTACACTATTACTCGAGTAATAGTGTAGATGCCCAGTA | 2372 | chr3 | ENST00000304552.4 |
| CXCR6 | AATTCAAAAATTATCTATGGCAATGTCTTTACTCGAGTAAAGACATTGCCATAGATAA | 2373 | chr3 | ENST00000304552.4 |
| EBI3 | AATTCAAAAATGAACTGTCACTGTGAGATATCTCGAGATATCTCACAGTGACAGTTCA | 2374 | chr19 | ENST00000221847.5 |
| EBI3 | AATTCAAAAAATGTACTACTCTCTCCTTTACCTCGAGGTAAAGGAGAGAGTAGTACAT | 2375 | chr19 | ENST00000221847.5 |
| EBI3 | AATTCAAAAAGCCTTTCATAACAGAGCACATCTCGAGATGTGCTCTGTTATGAAAGGC | 2376 | chr19 | ENST00000221847.5 |
| EDN1 | AATTCAAAAACCATGAGAAACAGCGTCAAATCTCGAGATTTGACGCTGTTTCTCATGG | 2377 | chr6 | ENST00000379375.5 |
| EDN1 | AATTCAAAAAGCTCGTCCCTGATGGATAAAGCTCGAGCTTTATCCATCAGGGACGAGC | 2378 | chr6 | ENST00000379375.5 |
| EDN1 | AATTCAAAAAAGACAAGAAGTGCTGGAATTTCTCGAGAAATTCCAGCACTTCTTGTCT | 2379 | chr6 | ENST00000379375.5 |
| ELANE | AATTCAAAAAGCACTGCGTGGCGAATGTAAACTCGAGTTTACATTCGCCACGCAGTGC | 2380 | chr19 | ENST00000263621.1 |
| ELANE | AATTCAAAAATGCTCAACGACATCGTGATTCCTCGAGGAATCACGATGTCGTTGAGCA | 2381 | chr19 | ENST00000263621.1 |
| ELANE | AATTCAAAAACAACGGGCTAATCCACGGAATCTCGAGATTCCGTGGATTAGCCCGTTG | 2382 | chr19 | ENST00000263621.1 |
| ENG | AATTCAAAAAGCAGGTGTCAGCAAGTATGATCTCGAGATCATACTTGCTGACACCTGC | 2383 | chr9 | ENST00000344849.4 |
| ENG | AATTCAAAAAGCAGGTGTCAGCAAGTATGATCTCGAGATCATACTTGCTGACACCTGC | 2384 | chr9 | ENST00000344849.4 |
| ENG | AATTCAAAAAGTCTTGCAGAAACAGTCCATTCTCGAGAATGGACTGTTTCTGCAAGAC | 2385 | chr9 | ENST00000344849.4 |
| EPO | AATTCAAAAACCCAGACACCAAAGTTAATTTCTCGAGAAATTAACTTTGGTGTCTGGG | 2386 | chr7 | ENST00000252723.2 |
| EPO | AATTCAAAAATGCAGCTGCATGTGGATAAAGCTCGAGCTTTATCCACATGCAGCTGCA | 2387 | chr7 | ENST00000252723.2 |
| EPO | AATTCAAAAAAGAGCAACTCTGAGATCTAAGCTCGAGCTTAGATCTCAGAGTTGCTCT | 2388 | chr7 | ENST00000252723.2 |
| FAM3B | AATTCAAAAATTGGAACTCCCTTCCGAAATTCTCGAGAATTTCGGAAGGGAGTTCCAA | 2389 | chr21 | ENST00000357985.6 |
| FAM3B | AATTCAAAAATAAATCCAACAGCCCATATTTCTCGAGAAATATGGGCTGTTGGATTTA | 2390 | chr21 | ENST00000357985.6 |
| FAM3B | AATTCAAAAATCAGGTCTAGCTGGGTATTTACTCGAGTAAATACCCAGCTAGACCTGA | 2391 | chr21 | ENST00000357985.6 |
| FAM3C | AATTCAAAAACTTGGTGTGTGCATGAGTATTCTCGAGAATACTCATGCACACACCAAG | 2392 | chr7 | ENST00000359943.7 |
| FAM3C | AATTCAAAAAGAGGAGATGTGGCACCATTTACTCGAGTAAATGGTGCCACATCTCCTC | 2393 | chr7 | ENST00000359943.7 |
| FAM3C | AATTCAAAAAGCCATACAAGATGGAACAATACTCGAGTATTGTTCCATCTTGTATGGC | 2394 | chr7 | ENST00000359943.7 |
| FAM3D | AATTCAAAAACACCTAGTGAATTCTTAAACTCGAGTTTAAGGAATTTCACTAGGTG | 2395 | chr3 | ENST00000358781.6 |
| FAM3D | AATTCAAAAACATGTACTCTGGAGATGTTATCTCGAGATAACATCTCCAGAGTACATG | 2396 | chr3 | ENST00000358781.6 |
| FAM3D | AATTCAAAAACAATGTGGGCAGAGGCCTAAACTCGAGTTTAGGCCTCTGCCCACATTG | 2397 | chr3 | ENST00000358781.6 |
| FAS | AATTCAAAAAGCGTATGACACATTGATTAAACTCGAGTTTAATCAATGTGTCATACGC | 2398 | chr10 | ENST00000355740.6 |
| FAS | AATTCAAAAACCTGAAACAGTGGCAATAAATCTCGAGATTTATTGCCACTGTTTCAGG | 2399 | chr10 | ENST00000355740.6 |
| FAS | AATTCAAAAACTATCATCCTCAAGGACATTACTCGAGTAATGTCCTTGAGGATGATAG | 2400 | chr10 | ENST00000355740.6 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| FASLG | AATTCAAAAAGACTAGAGGCTTGCATAATAACTCGAGTTATTATGCAAGCCTCTAGTC | 2401 | chr1 | ENST00000367721.2 |
| FASLG | AATTCAAAAAACTGGGCTGTACTTTGTATATCTCGAGATATACAAAGTACAGCCCAGT | 2402 | chr1 | ENST00000367721.2 |
| FASLG | AATTCAAAAATGAGCTCTCTCTGGTCAATTTCTCGAGAAATTGACCAGAGAGAGCTCA | 2403 | chr1 | ENST00000367721.2 |
| FGF2 | AATTCAAAAAGAAACGAACTGGGCAGTATAACTCGAGTTATACTGCCCAGTTCGTTTC | 2404 | chr4 | ENST00000608478.1 |
| FGF2 | AATTCAAAAATATAGCTCAGTTTGGATAATTCTCGAGAATTATCCAAACTGAGCTATA | 2405 | chr4 | ENST00000608478.1 |
| FGF2 | AATTCAAAAATGAACGATTGGAATCTAATAACTCGAGTTATTAGATTCCAATCGTTCA | 2406 | chr4 | ENST00000608478.1 |
| FLT3LG | AATTCAAAAACTGTCTGACTACCTGCTTCAACTCGAGTTGAAGCAGGTAGTCAGACAG | 2407 | chr19 | ENST00000594009.5 |
| FLT3LG | AATTCAAAAATCCTCCGACTTCGCTGTCAAACTCGAGTTTGACAGCGAAGTCGGAGGA | 2408 | chr19 | ENST00000594009.5 |
| FLT3LG | AATTCAAAAAGCTTCGTCCAGACCAACATCTCTCGAGAGATGTTGGTCTGGACGAAGC | 2409 | chr19 | ENST00000594009.5 |
| FOXP3 | AATTCAAAAAGCTGGAGTTCCGCAAGAAACCTCGAGGTTTCTTGCGGAACTCCAGCT | 2410 | chrX | ENST00000376207.8 |
| FOXP3 | AATTCAAAAATCCTACCCACTGCTGGCAAATCTCGAGATTTGCCAGCAGTGGGTAGGA | 2411 | chrX | ENST00000376207.8 |
| FOXP3 | AATTCAAAAATGTCCCTCACTCAACACAAACCTCGAGGTTTGTGTTGAGTGAGGGACA | 2412 | chrX | ENST00000376207.8 |
| FOXP3 | AATTCAAAAACACACGCATGTTTGCCTTCTTCTCGAGAAGAAGGCAAACATGCGTGTG | 2413 | chrX | ENST00000376207.8 |
| FZD4 | AATTCAAAAACGTGTGTGATTGCCTGTTATTCTCGAGAATAACAGGCAATCACACACG | 2414 | chr11 | ENST00000531380.1 |
| FZD4 | AATTCAAAAATCTCAGTATGTGCTATAATATCTCGAGATATTATAGCACATACTGAGA | 2415 | chr11 | ENST00000531380.1 |
| FZD4 | AATTCAAAAATTCTCAGTATGTGCTATAATACTCGAGTATTATAGCACATACTGAGAA | 2416 | chr11 | ENST00000531380.1 |
| GATA3 | AATTCAAAAAGCCTAAACGCGATGGATATACTCGAGTATATCCATCGCGTTTAGGCT | 2417 | chr10 | ENST00000346208.4 |
| GATA3 | AATTCAAAAACCCAAGAACAGCTCGTTTAACCTCGAGGTTAAACGAGCTGTTCTTGGG | 2418 | chr10 | ENST00000346208.4 |
| GATA3 | AATTCAAAAAGCCAAGAAGTTTAAGGAATATCTCGAGATATTCCTTAAACTTCTTGGC | 2419 | chr10 | ENST00000346208.4 |
| GATA3 | AATTCAAAAACCCTGTAATTGTTGTTTGTATCTCGAGATACAAACAACAATTACAGGG | 2420 | chr10 | ENST00000346208.4 |
| GBP1 | AATTCAAAAACCAGATGAGTACCTGACATACCTCGAGGTATGTCAGGTACTCATCTGG | 2421 | chr1 | ENST00000370473.4 |
| GBP1 | AATTCAAAAACGACGAAAGGCATGTACCATACTCGAGTATGGTACATGCCTTTCGTCG | 2422 | chr1 | ENST00000370473.4 |
| GBP1 | AATTCAAAAACGACGAAAGGCATGTACCATACTCGAGTATGGTACATGCCTTTCGTCG | 2423 | chr1 | ENST00000370473.4 |
| GDF1 | AATTCAAAAAGTTCACCAAGCTCAACATTTACTCGAGTAAATGTTGAGCTTGGTGAAC | 2424 | chr19 | ENST00000247005.7 |
| GDF1 | AATTCAAAAAGAGTTCACCAAGCTCAACATTCTCGAGAATGTTGAGCTTGGTGAACTC | 2425 | chr19 | ENST00000247005.7 |
| GDF1 | AATTCAAAAACCCTTATGAACCTCTACTGGTCTCGAGACCAGTAGAGGTTCATAAGGG | 2426 | chr19 | ENST00000247005.7 |
| GDF10 | AATTCAAAAACAGGATAATCGTGGTGTAAATCTCGAGATTTACACCACGATTATCCTG | 2427 | chr10 | ENST00000580279.1 |
| GDF10 | AATTCAAAAACGACCAGAAGGCCGTGTATTTCTCGAGAAATACACGGCCTTCTGGTCG | 2428 | chr10 | ENST00000580279.1 |
| GDF10 | AATTCAAAAACTGTCCGCCAGTGCATCATTACTCGAGTAATGATGCACTGGCGGACAG | 2429 | chr10 | ENST00000580279.1 |
| GDF11 | AATTCAAAAACCTGCAGATCTTGCGACTAAACTCGAGTTTAGTCGCAAGATCTGCAGG | 2430 | chr12 | ENST00000257868.9 |
| GDF11 | AATTCAAAAAGATCGCTGTGGCTGCTCTTAACTCGAGTTAAGAGCAGCCACAGCGATC | 2431 | chr12 | ENST00000257868.9 |
| GDF11 | AATTCAAAAAGAGATGTAGAGACAGTGATAGCTCGAGCTATCACTGTCTCTACATCTC | 2432 | chr12 | ENST00000257868.9 |
| GDF15 | AATTCAAAAAAGACTCCAGATTCCGAGAGTTCTCGAGAACTCTCGGAATCTGGAGTCT | 2433 | chr19 | ENST00000252809.3 |
| GDF15 | AATTCAAAAAGCTCCAGACCTATGATGACTTCTCGAGAAGTCATCATAGGTCTGGAGC | 2434 | chr19 | ENST00000252809.3 |
| GDF15 | AATTCAAAAAGAGCTGGGAAGATTCGAACACTCGAGTGTTCGAATCTTCCCAGCTCT | 2435 | chr19 | ENST00000252809.3 |
| GDF2 | AATTCAAAAACAACAGGTACACGTCCGATAACTCGAGTTATCGGACGTGTACCTGTTG | 2436 | chr10 | ENST00000581492.2 |
| GDF2 | AATTCAAAAATGAAAGGAAGCGTGGTCATTTCTCGAGAAATGACCACGCTTCCTTTCA | 2437 | chr10 | ENST00000581492.2 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| GDF2 | AATTCAAAAATATGAAGCCTACGAGTGTAAGCTCGAGCTTACACTCGTAGGCTTCATA | 2438 | chr10 | ENST00000581492.2 |
| GDF3 | AATTCAAAAACCGTCACCAGCTATTCATTACTCGAGTAATGAATAGCTGGTGACGGT | 2439 | chr12 | ENST00000329913.3 |
| GDF3 | AATTCAAAAACTCTCAACAGCTCCAATTATGCTCGAGCATAATTGGAGCTGTTGAGAG | 2440 | chr12 | ENST00000329913.3 |
| GDF3 | AATTCAAAAATTGGGCCAGGCAGTCCAATTTCTCGAGAAATTGGACTGCCTGGCCCAA | 2441 | chr12 | ENST00000329913.3 |
| GDF5 | AATTCAAAAACAACACCATCACCAGCTTTATCTCGAGATAAAGCTGGTGATGGTGTTG | 2442 | chr20 | ENST00000374369.7 |
| GDF5 | AATTCAAAAAATGAGACTCAGCCCACCATTTCTCGAGAAATGGTGGGCTGAGTCTCAT | 2443 | chr20 | ENST00000374369.7 |
| GDF5 | AATTCAAAAATGAGTGTGACTTGGGCTAAAGCTCGAGCTTTAGCCCAAGTCACACTCA | 2444 | chr20 | ENST00000374369.7 |
| GDF6 | AATTCAAAAAGACTCCCATCAGCATTCTATACTCGAGTATAGAATGCTGATGGGAGTC | 2445 | chr8 | ENST00000287020.6 |
| GDF6 | AATTCAAAAACGAGTACATGCTGTCAATCTACTCGAGTAGATTGACAGCATGTACTCG | 2446 | chr8 | ENST00000287020.6 |
| GDF6 | AATTCAAAAACAGTCTTCCAAGTCGGCTAATCTCGAGATTAGCCGACTTGGAAGACTG | 2447 | chr8 | ENST00000287020.6 |
| GDF7 | AATTCAAAAAGCAGAGGAAAGAGAGCTTATTCTCGAGAATAAGCTCTCTTTCCTCTGC | 2448 | chr2 | ENST00000272224.4 |
| GDF7 | AATTCAAAAAGTTCGACGTGTCCAGCCTTAACTCGAGTTAAGGCTGGACACGTCGAAC | 2449 | chr2 | ENST00000272224.4 |
| GDF7 | AATTCAAAAACCACTTCATGATGTCGCTTTACTCGAGTAAAGCGACATCATGAAGTGG | 2450 | chr2 | ENST00000272224.4 |
| GDF9 | AATTCAAAAAGATGGCTCAATTGCCTATAAACTCGAGTTTATAGGCAATTGAGCCATC | 2451 | chr5 | ENST00000378673.2 |
| GDF9 | AATTCAAAAACCATCAGTGGAACTGCTATTTCTCGAGAAATAGCAGTTCCACTGATGG | 2452 | chr5 | ENST00000378673.2 |
| GDF9 | AATTCAAAAAGAGTGAATACTTCAGACAATTCTCGAGAATTGTCTGAAGTATTCACTC | 2453 | chr5 | ENST00000378673.2 |
| GPI | AATTCAAAAACGTCTGGTATGTCTCCAACATCTCGAGATGTTGGAGACATACCAGACG | 2454 | chr19 | ENST00000356487.9 |
| GPI | AATTCAAAAACGTCTGGTATGTCTCCAACATCTCGAGATGTTGGAGACATACCAGACG | 2455 | chr19 | ENST00000356487.9 |
| GPI | AATTCAAAAAGCGGATGTTCAATGGTGAGAACTCGAGTTCTCACCATTGAACATCCGC | 2456 | chr19 | ENST00000356487.9 |
| GREM1 | AATTCAAAAAGCAGTGTCGTTGCATATCCATCTCGAGATGGATATGCAACGACACTGC | 2457 | chr15 | ENST00000622074.1 |
| GREM1 | AATTCAAAAAACAGCCACCTACCAAGAAGAACTCGAGTTCTTCTTGGTAGGTGGCTGT | 2458 | chr15 | ENST00000622074.1 |
| GREM1 | AATTCAAAAACAACAGTCGCACCATCATCAACTCGAGTTGATGATGGTGCGACTGTTG | 2459 | chr15 | ENST00000622074.1 |
| GREM2 | AATTCAAAAAGCTGTGAAGGAAGGAAATTTACTCGAGTAAATTTCCTTCCTTCACAGC | 2460 | chr1 | ENST00000318160.4 |
| GREM2 | AATTCAAAAACAAGGTGCATTTCTGTCATTTCTCGAGAAATGACAGAAATGCACCTTG | 2461 | chr1 | ENST00000318160.4 |
| GREM2 | AATTCAAAAACGGAAGTAGACGTAACTTATTCTCGAGAATAAGTTACGTCTACTTCCG | 2462 | chr1 | ENST00000318160.4 |
| GRN | AATTCAAAAAGCCCTGATAGTCAGTTCGAATCTCGAGATTCGAACTGACTATCAGGGC | 2463 | chr17 | ENST00000053867.7 |
| GRN | AATTCAAAAAGCCCTGATAGTCAGTTCGAATCTCGAGATTCGAACTGACTATCAGGGC | 2464 | chr17 | ENST00000053867.7 |
| GRN | AATTCAAAAACTTCCAAAGATCAGGTAACAACTCGAGTTGTTACCTGATCTTTGGAAG | 2465 | chr17 | ENST00000053867.7 |
| HAX1 | AATTCAAAAAACAGACACTTCGGGACTCAATCTCGAGATTGAGTCCCGAAGTGTCTGT | 2466 | chr1 | ENST00000328703.11 |
| HAX1 | AATTCAAAAACCAGCCCAAATCCTATTTCAACPCGAGTTGAAATAGGATTTGGGCTGG | 2467 | chr1 | ENST00000328703.11 |
| HAX1 | AATTCAAAAACCAGAGGCCATTTCATAGGTTCTCGAGAACCTATGAAATGGCCTCTGG | 2468 | chr1 | ENST00000328703.11 |
| HFE2 | AATTCAAAAAGACATGATCATTAGCCATAAGCTCGAGCTTATGGCTAATGATCATGTC | 2469 | chr1 | ENST00000336751.10 |
| HFE2 | AATTCAAAAAGCCTACATTGGCACAACTATACTCGAGTATAGTTGTGCCAATGTAGGC | 2470 | chr1 | ENST00000336751.10 |
| HFE2 | AATTCAAAAAGAAGCTCACCATCATATTTAACTCGAGTTAAATATGATGGTGAGCTTC | 2471 | chr1 | ENST00000336751.10 |
| HMGB1 | AATTCAAAAAGATGCAGCTTATACGAAATAACTCGAGTTATTTCGTATAAGCTGCATC | 2472 | chr13 | ENST00000339872.8 |
| HMGB1 | AATTCAAAAAGTTGGTGCACAGCACAAATTACTCGAGTAATTTGTGCTGTGCACCAAC | 2473 | chr13 | ENST00000339872.8 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| HMGB1 | AATTCAAAAAGAAGATGATGATGATGAATACTCGAGTATTCATCATCATCATCTTCT | 2474 | chr13 | ENST00000339872.8 |
| HYAL2 | AATTCAAAAACCTGCCAGTACCTCAAAGATTCTCGAGAATCTTTGAGGTACTGGCAGG | 2475 | chr3 | ENST00000357750.8 |
| HYAL2 | AATTCAAAAACCTGCCAGTACCTCAAAGATTCTCGAGAATCTTTGAGGTACTGGCAGG | 2476 | chr3 | ENST00000357750.8 |
| HYAL2 | AATTCAAAAACTGGACCTGAATGCCTTTGATCTCGAGATCAAAGGCATTCAGGTCCAG | 2477 | chr3 | ENST00000357750.8 |
| ICAM3 | AATTCAAAAAGTCCAGCTCACGAGGCAAATACTCGAGTATTTGCCTCGTGAGCTGGAC | 2478 | chr19 | ENST00000160262.9 |
| ICAM3 | AATTCAAAAACCAGCTCAACTTCAGCTAAATCTCGAGATTTAGCTGAAGTTGAGCTGG | 2479 | chr19 | ENST00000160262.9 |
| ICAM3 | AATTCAAAAAGCACTTGAAATGGAAAGATAACTCGAGTTATCTTTCCATTTCAAGTGC | 2480 | chr19 | ENST00000160262.9 |
| ICAM3 | AATTCAAAAAGAGCGGCAGTTACCATGTTAGCTCGAGCTAACATGGTAACTGCCGCTC | 2481 | chr19 | ENST00000160262.9 |
| ICOS | AATTCAAAAAGCACGACCCTAACGGTGAATACTCGAGTATTCACCGTTAGGGTCGTGC | 2482 | ch2 | ENST00000316386.10 |
| ICOS | AATTCAAAAAGTCCGCATTTCACTATCATACCTCGAGGTATGATAGTGAAATGCGGAC | 2483 | ch2 | ENST00000316386.10 |
| ICOS | AATTCAAAAACCATTCTCATGCCAACTATTACTCGAGTAATAGTTGGCATGAGAATGG | 2484 | ch2 | ENST00000316386.10 |
| ICOS | AATTCAAAAACACAGATGTGACCCTATAATACTCGAGTATTATAGGGTCACATCTGTG | 2485 | ch2 | ENST00000316386.10 |
| IFNA10 | AATTCAAAAATGTAAAGAAGTGTCGTGTATACTCGAGTATACACGACACTTCTTTACA | 2486 | chr9 | ENST00000357374.2 |
| IFNA10 | AATTCAAAAAATAACCACGACGCGTTGAATCCTCGAGGATTCAACGCGTCGTGGTTAT | 2487 | chr9 | ENST00000357374.2 |
| IFNA10 | AATTCAAAAACCTGGGACAAATGGGAAGAATCTCGAGATTCTTCCCATTTGTCCCAGG | 2488 | chr9 | ENST00000357374.2 |
| IFNA14 | AATTCAAAAACTGGGCTGTAATCTGTCTCAACTCGAGTTGAGACAGATTACAGCCCAG | 2489 | chr9 | ENST00000380222.3 |
| IFNA14 | AATTCAAAAACCTGAATAACAGGAGGACTTTCTCGAGAAAGTCCTCCTGTTATTCAGG | 2490 | chr9 | ENST00000380222.3 |
| IFNA14 | AATTCAAAAAGCAGCAGACCTTCAATCTCTTCTCGAGAAGAGATTGAAGGTCTGCTGC | 2491 | chr9 | ENST00000380222.3 |
| IFNA16 | AATTCAAAAATGTAAAGAAGCATCGTGTTTACTCGAGTAAACACGATGCTTCTTTACA | 2492 | chr9 | ENST00000380216.1 |
| IFNA16 | AATTCAAAAAATGATCCTCATTGATTAATACCTCGAGGTATTAATCAATGAGGATCAT | 2493 | chr9 | ENST00000380216.1 |
| IFNA16 | AATTCAAAAACCTGAAGGACAGATATGATTTCTCGAGAAATCATATCTGTCCTTCAGG | 2494 | chr9 | ENST00000380216.1 |
| IFNA2 | AATTCAAAAAGCACAGTGGTTAATGTAATAACTCGAGTTATTACATTAACCACTGTGC | 2495 | chr9 | ENST00000380206.3 |
| IFNA2 | AATTCAAAAATATGACCATGACACGATTTAACTCGAGTTAAATCGTGTCATGGTCATA | 2496 | chr9 | ENST00000380206.3 |
| IFNA2 | AATTCAAAAACCATGCTGACTGATCCATTATCTCGAGATAATGGATCAGTCAGCATGG | 2497 | chr9 | ENST00000380206.3 |
| IFNA5 | AATTCAAAAAACTTGGGATGAGACACTTCTACTCGAGTAGAAGTGTCTCATCCCAAGT | 2498 | chr9 | ENST00000610521.1 |
| IFNA5 | AATTCAAAAAGTGGAAGACACTCCTCTGATCTCGAGATCAGAGGAGTGTCTTCCACT | 2499 | chr9 | ENST00000610521.1 |
| IFNA5 | AATTCAAAAATCAACTGCAAGTCAATCTGTTCTCGAGAACAGATTGACTTGCAGTTGA | 2500 | chr9 | ENST00000610521.1 |
| IFNA6 | AATTCAAAAAGACAGACATGACTTCAGATTTCTCGAGAAATCTGAAGTCATGTCTGTC | 2501 | chr9 | ENST00000380210.1 |
| IFNA6 | AATTCAAAAACTGTCCTCCATGAGGTGATTCCTCGAGGAATCACCTCATGGAGGACAG | 2502 | chr9 | ENST00000380210.1 |
| IFNA6 | AATTCAAAAAGGCTTCTAGACAAACTCTATCTCGAGATAGAGTTTGTCTAGAAGCCT | 2503 | chr9 | ENST00000380210.1 |
| IFNA8 | AATTCAAAAATAACTATCTATAGGGCTTAAACTCGAGTTTAAGCCCTATAGATAGTTA | 2504 | chr9 | ENST00000380205.1 |
| IFNA8 | AATTCAAAAACCAGGAGGAGTTTGATGATAACTCGAGTTATCATCAAACTCCTCCTGG | 2505 | chr9 | ENST00000380205.1 |
| IFNA8 | AATTCAAAAAGACCTGGTACAACACGGAAATCTCGAGATTTCCGTGTTGTACCAGGTC | 2506 | chr9 | ENST00000380205.1 |
| IFNAR1 | AATTCAAAAAGCCAAGATTCAGGAAATTATTCTCGAGAATAATTTCCTGAATCTTGGC | 2507 | chr21 | ENST00000270139.7 |
| IFNAR1 | AATTCAAAAAGCTCTCCCGTTTGTCATTTATCTCGAGATAAATGACAAACGGGAGAGC | 2508 | chr21 | ENST00000270139.7 |
| IFNAR1 | AATTCAAAAATGAACTGTGTCAAGTATAAGCTCGAGCTTATACTTGACACAGTTCAT | 2509 | chr21 | ENST00000270139.7 |
| IFNAR2 | AATTCAAAAAGAGTGGAAATTTCACCTATATCTCGAGATATAGGTGAAATTTCCACTC | 2510 | chr21 | ENST00000342136.8 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
| --- | --- | --- | --- | --- |
| IFNAR2 | AATTCAAAAATGTATATCAGCCTCGTGTTTGCTCGAGCAAACACGAGGCTGATATACA | 2511 | chr21 | ENST00000342136.8 |
| IFNAR2 | AATTCAAAAAGCAAATACCACAAGATCATTTCTCGAGAAATGATCTTGTGGTATTTGC | 2512 | chr21 | ENST00000342136.8 |
| IFNB1 | AATTCAAAAATTGAATGGGAGGCTTGAATACTCGAGTATTCAAGCCTCCCATTCAAT | 2513 | chr9 | ENST00000380232.3 |
| IFNB1 | AATTCAAAAACCTACAAAGAAGCAGCAATTTCTCGAGAAATTGCTGCTTCTTTGTAGG | 2514 | chr9 | ENST00000380232.3 |
| IFNB1 | AATTCAAAAACTAATGTCTATCATCAGATAACTCGAGTTATCTGATGATAGACATTAG | 2515 | chr9 | ENST00000380232.3 |
| IFNE | AATTCAAAAAGGTAGTGATAACCTTAGATTACTCGAGTAATCTAAGGTTATCACTACC | 2516 | chr9 | ENST00000448696.4 |
| IFNE | AATTCAAAAAGCCTCTTCAGGGCAAATATTCTCGAGAATATTTGCCCTGAAGAGGCT | 2517 | chr9 | ENST00000448696.4 |
| IFNE | AATTCAAAAACATAGAGTGGTAATACAATTTCTCGAGAAATTGTATTACCACTCTATG | 2518 | chr9 | ENST00000448696.4 |
| IFNG | AATTCAAAAAGGTTGTCCTGCCTGCAATATTCTCGAGAATATTGCAGGCAGGACAACC | 2519 | chr12 | ENST00000229135.3 |
| IFNG | AATTCAAAAACATTCAGATGTAGCGGATAATCTCGAGATTATCCGCTACATCTGAATG | 2520 | chr12 | ENST00000229135.3 |
| IFNG | AATTCAAAAATGTTACTGCCAGGACCCATATCTCGAGATATGGGTCCTGGCAGTAACA | 2521 | chr12 | ENST00000229135.3 |
| IFNGR1 | AATTCAAAAAACGAGCAGGAAGTCGATTATGCTCGAGCATAATCGACTTCCTGCTCGT | 2522 | chr6 | ENST00000367739.8 |
| IFNGR1 | AATTCAAAAACATGAACCCTATCGTATATTGCTCGAGCAATATACGATAGGGTTCATG | 2523 | chr6 | ENST00000367739.8 |
| IFNGR1 | AATTCAAAAACGGAAGTGAGATCCAGTATAACTCGAGTTATACTGGATCTCACTTCCG | 2524 | chr6 | ENST00000367739.8 |
| IFNK | AATTCAAAAAGAGATTGTGGCTACGCAAATGCTCGAGCATTTGCGTAGCCACAATCTC | 2525 | chr9 | ENST00000276943.2 |
| IFNK | AATTCAAAAACTGTTCAGATTCAAGATTATTCTCGAGAATAATCTTGAATCTGAACAG | 2526 | chr9 | ENST00000276943.2 |
| IFNK | AATTCAAAAATCAGCCAACACACCTTCAAATCTCGAGATTTGAAGGTGTGTTGGCTGA | 2527 | chr9 | ENST00000276943.2 |
| IFNL1 | AATTCAAAAACTCACGCGAGACCTCAAATATCTCGAGATATTTGAGGTCTCGCGTGAG | 2528 | chr19 | ENST00000333625.2 |
| IFNL1 | AATTCAAAAAGCCACATTGGCAGGTTCAAATCTCGAGATTTGAACCTGCCAATGTGGC | 2529 | chr19 | ENST00000333625.2 |
| IFNL1 | AATTCAAAAAGAGTTGCAGCTCTCCTGTCTTCTCGAGAAGACAGGAGAGCTGCAACTC | 2530 | chr19 | ENST00000333625.2 |
| IFNL3 | AATTCAAAAAGGGCCAAAGATGCCTTAGAACTCGAGTTCTAAGGCATCTTTGGCCCT | 2531 | chr19 | ENST00000413851.2 |
| IFNL3 | AATTCAAAAAGCCTTTAAGAGGGCAAAGATCTCGAGATCTTTGGCCCTCTTAAAGGC | 2532 | chr19 | ENST00000413851.2 |
| IFNL3 | AATTCAAAAATGCCACATAGCCCAGTTCAAGCTCGAGCTTGAACTGGGCTATGTGGCA | 2533 | chr19 | ENST00000413851.2 |
| IFNW1 | AATTCAAAAAAGACTCTTATTTCGGCTTTAACTCGAGTTAAAGCCGAAATAAGAGTCT | 2534 | chr9 | ENST00000380229.3 |
| IFNW1 | AATTCAAAAATCAGTCCCTAAGATGTTATTTCTCGAGAAATAACATCTTAGGGACTGA | 2535 | chr9 | ENST00000380229.3 |
| IFNW1 | AATTCAAAAACGGTATATTAAGCCAGTATATCTCGAGATATACTGGCTTAATATACCG | 2536 | chr9 | ENST00000380229.3 |
| IL10 | AATTCAAAAAGCTTCTCTGTGAACGATTTACTCGAGTAAATCGTTCACAGAGAAGCT | 2537 | chr1 | ENST00000423557.1 |
| IL10 | AATTCAAAAAGCAGGTGAAGAATGCCTTTAACTCGAGTTAAAGGCATTCTTCACCTGC | 2538 | chr1 | ENST00000423557.1 |
| IL10 | AATTCAAAAAGCTGGACAACTTGTTGTTAAACTCGAGTTTAACAACAAGTTGTCCAGC | 2539 | chr1 | ENST00000423557.1 |
| IL10RA | AATTCAAAAATCTGTCGCTTCCCGAAGTAACCTCGAGGTTACTTCGGGAAGCGACAGA | 2540 | chr11 | ENST00000227752.7 |
| IL10RA | AATTCAAAAAGAAACAGGATCCTCTAGAAATCTCGAGATTTCTAGAGGATCCTGTTTC | 2541 | chr11 | ENST00000227752.7 |
| IL10RA | AATTCAAAAAGAACTCTTTCCTGTATCATAACTCGAGTTATGATACAGGAAAGAGTTC | 2542 | chr11 | ENST00000227752.7 |
| IL11 | AATTCAAAAAATATCCACTTGAGGGCGATTTCTCGAGAAATCGCCCTCAAGTGGATAT | 2543 | chr19 | ENST00000264563.6 |
| IL11 | AATTCAAAAACCTTCCAAAGCCAGATCTTATCTCGAGATAAGATCTGGCTTTGGAAGG | 2544 | chr19 | ENST00000264563.6 |
| IL11 | AATTCAAAAATGCACAGCTGAGGGACAAATTCTCGAGAATTTGTCCCTCAGCTGTGCA | 2545 | chr19 | ENST00000264563.6 |
| IL11RA | AATTCAAAAACGGCAGATTCCACCTATAATTCTCGAGAATTATAGGTGGAATCTGCCG | 2546 | chr9 | ENST00000318041.13 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| IL11RA | AATTCAAAAATCGGCAGATTCCACCTATAATCTCGAGATTATAGGTGGAATCTGCCGA | 2547 | chr9 | ENST00000318041.13 |
| IL11RA | AATTCAAAAATGGAGCCAGTACCGGATTAATCTCGAGATTAATCCGGTACTGGCTCCA | 2548 | chr9 | ENST00000318041.13 |
| IL12A | AATTCAAAAATGATACCTCTGATCAAGTATTCTCGAGAATACTTGATCAGAGGTATCA | 2549 | chr3 | ENST00000305579.6 |
| IL12A | AATTCAAAAACCTGTGCCTTAGTAGTATTTACTCGAGTAAATACTACTAAGGCACAGG | 2550 | chr3 | ENST00000305579.6 |
| IL12A | AATTCAAAAACCTGTTTACCATTGGAATTAACTCGAGTTAATTCCAATGGTAAACAGG | 2551 | chr3 | ENST00000305579.6 |
| IL12B | AATTCAAAAAGAATTTGGTCCACTGATATTTCTCGAGAAATATCAGTGGACCAAATTC | 2552 | chr5 | ENST00000231228.2 |
| IL12B | AATTCAAAAACCATGGGCCTTCATGCTATTTCTCGAGAAATAGCATGAAGGCCCATGG | 2553 | chr5 | ENST00000231228.2 |
| IL12B | AATTCAAAAATTAGATGCTAAATGCTCATTGCTCGAGCAATGAGCATTTAGCATCTAA | 2554 | chr5 | ENST00000231228.2 |
| IL12RB1 | AATTCAAAAACAGCTCTACAACTCAGTTAAACTCGAGTTTAACTGAGTTGTAGAGCTG | 2555 | chr19 | ENST00000593993.6 |
| IL12RB1 | AATTCAAAAAGTCATCTCCTCGAACCAATTTCTCGAGAAATTGGTTCGAGGAGATGAC | 2556 | chr19 | ENST00000593993.6 |
| IL12RB1 | AATTCAAAAACCAACGGGACCACCATGTATTCTCGAGAATACATGGTGGTCCCGTTGG | 2557 | chr19 | ENST00000593993.6 |
| IL13 | AATTCAAAAAACTTCGAAAGCATCATTATTTCTCGAGAAATAATGATGCTTTCGAAGT | 2558 | chr5 | ENST00000304506.7 |
| IL13 | AATTCAAAAAATTGAAGTTGCAGATTCATTTCTCGAGAAATGAATCTGCAACTTCAAT | 2559 | chr5 | ENST00000304506.7 |
| IL13 | AATTCAAAAACCTGCTCTTACATTTAAAGAACTCGAGTTCTTTAAATGTAAGAGCAGG | 2560 | chr5 | ENST00000304506.7 |
| IL15 | AATTCAAAAAGAAGATCTTATTCAATCTATGCTCGAGCATAGATTGAATAAGATCTTC | 2561 | chr4 | ENST00000296545.11 |
| IL15 | AATTCAAAAATAAGGGTGATAGTCAAATTATCTCGAGATAATTTGACTATCACCCTTA | 2562 | chr4 | ENST00000296545.11 |
| IL15 | AATTCAAAAACACTCTGCTGCTTAGACATAACTCGAGTTATGTCTAAGCAGCAGAGTG | 2563 | chr4 | ENST00000296545.11 |
| IL16 | AATTCAAAAATGGGACCACGTGAGATCATTCCTCGAGGAATGATCTCACGTGGTCCCA | 2564 | chr15 | ENST00000302987.8 |
| IL16 | AATTCAAAAAGTTCTGGATGAAGCAACATTACTCGAGTAATGTTGCTTCATCCAGAAC | 2565 | chr15 | ENST00000302987.8 |
| IL16 | AATTCAAAAACCCAAACAGTGACATTTATTTCTCGAGAAATAAATGTCACTGTTTGGG | 2566 | chr15 | ENST00000302987.8 |
| IL17A | AATTCAAAAAATCAGTTCTGCCTAGGTAAATCTCGAGATTTACCTAGGCAGAACTGAT | 2567 | chr6 | ENST00000340057.1 |
| IL17A | AATTCAAAAAGAGCTATTTAAGGATCTATTTCTCGAGAAATAGATCCTTAAATAGCTC | 2568 | chr6 | ENST00000340057.1 |
| IL17A | AATTCAAAAAGGTCAACCTGAACATCCATAACTCGAGTTATGGATGTTCAGGTTGACC | 2569 | chr6 | ENST00000340057.1 |
| IL17B | AATTCAAAAATATGCCCGCATGGAGGAGTATCTCGAGATACTCCTCCATGCGGGCATA | 2570 | chr5 | ENST00000261796.3 |
| IL17B | AATTCAAAAAGTGTCACGGATGAAACCGTATCTCGAGATACGGTTTCATCCGTGACAC | 2571 | chr5 | ENST00000261796.3 |
| IL17B | AATTCAAAAAGCAGCTGTGGATGTCCAACAACTCGAGTTGTTGGACATCCACAGCTGC | 2572 | chr5 | ENST00000261796.3 |
| IL17C | AATTCAAAAAGCACCTCTTCCAGCCCTTAAACTCGAGTTTAAGGGCTGGAAGAGGTGC | 2573 | chr16 | ENST00000244241.4 |
| IL17C | AATTCAAAAACTTTGCCTTCCACACCGAGTTCTCGAGAACTCGGTGTGGAAGGCAAAG | 2574 | chr16 | ENST00000244241.4 |
| IL17C | AATTCAAAAAATCTCCAGCCTCAGTAGTTGGCTCGAGCCAACTACTGAGGCTGGAGAT | 2575 | chr16 | ENST00000244241.4 |
| IL17D | AATTCAAAAAGAGCTACTCTGTTACATTTCCTCGAGGAAATGTAACAGAGTAGCTCT | 2576 | chr13 | ENST00000304920.3 |
| IL17D | AATTCAAAAACAAAGAGATAGGGACGCATATCTCGAGATATGCGTCCCTATCTCTTTG | 2577 | chr13 | ENST00000304920.3 |
| IL17D | AATTCAAAAAGACAGCATCAACTCCAGCATCTCGAGATGCTGGAGTTGATGCTGTCT | 2578 | chr13 | ENST00000304920.3 |
| IL17F | AATTCAAAAATCATCCACCATGTGCAGTAAGCTCGAGCTTACTGCACATGGTGGATGA | 2579 | chr6 | ENST00000336123.4 |
| IL17F | AATTCAAAAAGTACTTGCTGCTGTCGATATTCTCGAGAATATCGACAGCAGCAAGTAC | 2580 | chr6 | ENST00000336123.4 |
| IL17F | AATTCAAAAACGTTTCCATGTCACGTAACATCTCGAGATGTTACGTGACATGGAAACG | 2581 | chr6 | ENST00000336123.4 |
| IL18 | AATTCAAAAACCCGGACCATATTTATTATAACTCGAGTTATAATAAATATGGTCCGGG | 2582 | chr11 | ENST00000280357.11 |
| IL18 | AATTCAAAAATGATTCTGACTGTAGAGATAACTCGAGTTATCTCTACAGTCAGAATCA | 2583 | chr11 | ENST00000280357.11 |

TABLE 16-continued

3' to 5' (Reverse) shRNA sequences for Silencing of Cytokine/Chemokine
Genes to Reduce the Incidence of CRS

| Target Gene Symbol | shRNA Reverse Oligo Sequence | SEQ ID NO: | Location | Gene ID No. |
|---|---|---|---|---|
| IL18 | AATTCAAAAATGGCAAGCTTGAATCTAAATTCTCGAGAATTTAGATTCAAGCTTGCCA | 2584 | chr11 | ENST00000280357.11 |
| IL18BP | AATTCAAAAAGGTCCCTTCTCTCACCAAATTCTCGAGAATTTGGTGAGAGAAGGGACC | 2585 | chr11 | ENST00000260049.9 |
| IL18BP | AATTCAAAAATCCCATGTCTCTGCTCATTTACTCGAGTAAATGAGCAGAGACATGGGA | 2586 | chr11 | ENST00000260049.9 |
| IL18BP | AATTCAAAAACTGGGCAATGGTTCCTTCATTCTCGAGAATGAAGGAACCATTGCCCAG | 2587 | chr11 | ENST00000260049.9 |
| IL19 | AATTCAAAAAGTCCACGCTGCTGCCATTAAACTCGAGTTTAATGGCAGCAGCGTGGAC | 2588 | chr1 | ENST00000270218.10 |
| IL19 | AATTCAAAAATCCACAGACATGCACCATATACTCGAGTATATGGTGCATGTCTGTGGA | 2589 | chr1 | ENST00000270218.10 |
| IL19 | AATTCAAAAATGATGACAAGGAACCTGTATACTCGAGTATACAGGTTCCTTGTCATCA | 2590 | chr1 | ENST00000270218.10 |
| IL1A | AATTCAAAAAGTGGAACCAACACTAACATATCTCGAGATATGTTAGTGTTGGTTCCAC | 2591 | chr2 | ENST00000263339.3 |
| IL1A | AATTCAAAAAGCCCTCAATCAAAGTATAATTCTCGAGAATTATACTTTGATTGAGGGC | 2592 | chr2 | ENST00000263339.3 |
| IL1A | AATTCAAAAATATTACAGATGGGCAAATTAACTCGAGTTAATTTGCCCATCTGTAATA | 2593 | chr2 | ENST00000263339.3 |
| IL1B | AATTCAAAAAATCAATAACAAGCTGGAATTTCTCGAGAAATTCCAGCTTGTTATTGAT | 2594 | chr2 | ENST00000263341.6 |
| IL1B | AATTCAAAAAAGCAACCGCTTCCCTATTTATCTCGAGATAAATAGGGAAGCGGTTGCT | 2595 | chr2 | ENST00000263341.6 |
| IL1B | AATTCAAAAACTGACTTCACCATGCAATTTGCTCGAGCAAATTGCATGGTGAAGTCAG | 2596 | chr2 | ENST00000263341.6 |
| IL1F10 | AATTCAAAAATCCTTGTGGGCTCAGTTTAATCTCGAGATTAAACTGAGCCCACAAGGA | 2597 | chr2 | ENST00000341010.6 |
| IL1F10 | AATTCAAAAAGGTCTATGGTAGGCAGAATAACTCGAGTTATTCTGCCTACCATAGACC | 2598 | chr2 | ENST00000341010.6 |
| IL1F10 | AATTCAAAAATGCAGACCAGAAGGCTCTATACTCGAGTATAGAGCCTTCTGGTCTGCA | 2599 | chr2 | ENST00000341010.6 |
| IL1R1 | AATTCAAAAAGCCAAGAATACACATGGTATACTCGAGTATACCATGTGTATTCTTGGC | 2600 | chr2 | ENST00000410023.5 |
| IL1R1 | AATTCAAAAAATAATGCACAAGCCATATTTACTCGAGTAAATATGGCTTGTGCATTAT | 2601 | chr2 | ENST00000410023.5 |
| IL1R1 | AATTCAAAAATGGTATAGATGCAGCATATATCTCGAGATATATGCTGCATCTATACCA | 2602 | chr2 | ENST00000410023.5 |
| IL1R2 | AATTCAAAAACAATCCCGTGTAAGGTGTTTCCTCGAGGAAACACCTTACACGGGATTG | 2603 | chr2 | ENST00000332549.7 |
| IL1R2 | AATTCAAAAAGACCATTCCTGTGATCATTTCCTCGAGGAAATGATCACAGGAATGGTC | 2604 | chr2 | ENST00000332549.7 |
| IL1R2 | AATTCAAAAACGTTCATCTCATACCCGCAAACTCGAGTTTGCGGGTATGAGATGAACG | 2605 | chr2 | ENST00000332549.7 |
| IL1RAPL1 | AATTCAAAAACAAAGCAAGCGGCTGATTATTCTCGAGAATAATCAGCCGCTTGCTTTG | 2606 | chrX | ENST00000378993.5 |
| IL1RAPL1 | AATTCAAAAAGCCAGCGTTCTCCTTCATAAACTCGAGTTTATGAAGGAGAACGCTGGC | 2607 | chrX | ENST00000378993.5 |
| IL1RAPL1 | AATTCAAAAATCAAGCTCCTGACGGTCATTACTCGAGTAATGACCGTCAGGAGCTTGA | 2608 | chrX | ENST00000378993.5 |
| IL1RL1 | AATTCAAAAATTACACCGTGGATTGGTATTACTCGAGTAATACCAATCCACGGTGTAA | 2609 | chr2 | ENST00000233954.5 |
| IL1RL1 | AATTCAAAAAGTTGCTGATTCTGGTATTTACTCGAGTAAATACCAGAATCAGCAACT | 2610 | chr2 | ENST00000233954.5 |
| IL1RL1 | AATTCAAAAACGTGAAGGAAGAGGATTTATTCTCGAGAATAAATCCTCTTCCTTCACG | 2611 | chr2 | ENST00000233954.5 |
| IL1RN | AATTCAAAAAGCAAGGACCCAAATGTCAATTTCTCGAGAAATTGACATTTGGTCCTTGC | 2612 | chr2 | ENST00000409930.3 |
| IL1RN | AATTCAAAAACGTCATGGTCACCAAATTCTACTCGAGTAGAATTTGGTGACCATGACG | 2613 | chr2 | ENST00000409930.3 |
| IL1RN | AATTCAAAAACTGCCTCCAGAATGGTCTTTCCTCGAGGAAAGACCATTCTGGAGGCAG | 2614 | chr2 | ENST00000409930.3 |
| IL2 | AATTCAAAAAGCTACCTATTGTAACTATTATCTCGAGATAATAGTTACAATAGGTAGC | 2615 | chr4 | ENST00000226730.4 |
| IL2 | AATTCAAAAACAGCTACAACTGGAGCATTTACTCGAGTAAATGCTCCAGTTGTAGCTG | 2616 | chr4 | ENST00000226730.4 |
| IL2 | AATTCAAAAATGCTGGATTTACAGATGATTTCTCGAGAAATCATCTGTAAATCCAGCA | 2617 | chr4 | ENST00000226730.4 |
| IL20 | AATTCAAAAACTGATGCTCTGTGAGATATTTCTCGAGAAATATCTCACAGAGCATCAG | 2618 | chr1 | ENST00000367096.7 |
| IL20 | AATTCAAAAATGGTCACAGTGTATCTTATTTCTCGAGAAATAAGATACACTGTGACCA | 2619 | chr1 | ENST00000367096.7 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| IL20 | AATTCAAAAAGGACTGAAGACACTCAATTTGCTCGAGCAAATTGAGTGTCTTCAGTCC | 2620 | chr1 | ENST00000367096.7 |
| IL20RA | AATTCAAAAACCAGTATTATGCCAAAGTTAACTCGAGTTAACTTTGGCATAATACTGG | 2621 | chr6 | ENST00000316649.9 |
| IL20RA | AATTCAAAAAGAGGGTCTTCAAGGAGTTAAACTCGAGTTTAACTCCTTGAAGACCCTC | 2622 | chr6 | ENST00000316649.9 |
| IL20RA | AATTCAAAAAGCTTCGCATTTGATGGAAATTCTCGAGAATTTCCATCAAATGCGAAGC | 2623 | chr6 | ENST00000316649.9 |
| IL20RB | AATTCAAAAACAGTGTACTATTCTGTCGAATCTCGAGATTCGACAGAATAGTACACTG | 2624 | chr3 | ENST00000329582.8 |
| IL20RB | AATTCAAAAACCAGAATAATCCTTGAGAGAACTCGAGTTCTCTCAAGGATTATTCTGG | 2625 | chr3 | ENST00000329582.8 |
| IL20RB | AATTCAAAAACTCTGTACTCTCAACCAACATCTCGAGATGTTGGTTGAGAGTACAGAG | 2626 | chr3 | ENST00000329582.8 |
| IL21 | AATTCAAAAAAGGAAACCACCTTCCACAAATCTCGAGATTTGTGGAAGGTGGTTTCCT | 2627 | chr4 | ENST00000264497.7 |
| IL21 | AATTCAAAAAATGACTTGGTCCCTGAATTTCCTCGAGGAAATTCAGGGACCAAGTCAT | 2628 | chr4 | ENST00000264497.7 |
| IL21 | AATTCAAAAACTTTCAGAAGGCCCAACTAAACTCGAGTTTAGTTGGGCCTTCTGAAAG | 2629 | chr4 | ENST00000264497.7 |
| IL22 | AATTCAAAAAGGCTAAGCACATGTCATATTCTCGAGAATATGACATGTGCTTAGCCT | 2630 | chr12 | ENST00000328087.5 |
| IL22 | AATTCAAAAAGTTTCCATAATCAGTACTTTACTCGAGTAAAGTACTGATTATGGAAAC | 2631 | chr12 | ENST00000328087.5 |
| IL22 | AATTCAAAAAGACTTTCTAAGCATAGATATCTCGAGATATCTATGCTTAGAAAGTCT | 2632 | chr12 | ENST00000328087.5 |
| IL22RA1 | AATTCAAAAAGGACACTTTCTAGTCCTAAACCTCGAGGTTTAGGACTAGAAAGTGTCC | 2633 | chr1 | ENST00000270800.1 |
| IL22RA1 | AATTCAAAAAGGGACACCACAGTACCTAAACTCGAGTTTAGGTACTGTGGTGTCCCT | 2634 | chr1 | ENST00000270800.1 |
| IL22RA1 | AATTCAAAAACTGTCCGAGATCACCTACTTACTCGAGTAAGTAGGTGATCTCGGACAG | 2635 | chr1 | ENST00000270800.1 |
| IL22RA2 | AATTCAAAAAGACATACAGGAACCTTATTACTCGAGTAATAAGGTTCCTGTATGTCT | 2636 | chr6 | ENST00000349184.8 |
| IL22RA2 | AATTCAAAAACTCGTGTTTGAAGGATCTTATCTCGAGATAAGATCCTTCAAACACGAG | 2637 | chr6 | ENST00000349184.8 |
| IL22RA2 | AATTCAAAAATGCTCCAAATTTACCATATAGCTCGAGCTATATGGTAAATTTGGAGCA | 2638 | chr6 | ENST00000349184.8 |
| IL23A | AATTCAAAAAGCTGCTAGGATCGGATATTTCTCGAGAAATATCCGATCCTAGCAGCT | 2639 | chr12 | ENST00000228534.5 |
| IL23A | AATTCAAAAACTGTGAGCCAACAGGTTAATTCTCGAGAATTAACCTGTTGGCTCACAG | 2640 | chr12 | ENST00000228534.5 |
| IL23A | AATTCAAAAAGGATCCACCAGGGTCTGATTTCTCGAGAAATCAGACCCTGGTGGATCC | 2641 | chr12 | ENST00000228534.5 |
| IL23R | AATTCAAAAACTTTCTTTGATTGGGATATTTCTCGAGAAATATCCCAATCAAAGAAAG | 2642 | chr1 | ENST00000347310.9 |
| IL23R | AATTCAAAAATATCTCACCTCAAGCTATATTCTCGAGAATATAGCTTGAGGTGAGATA | 2643 | chr1 | ENST00000347310.9 |
| IL23R | AATTCAAAAACGACAATACTACAGTTGTATACTCGAGTATACAACTGTAGTATTGTCG | 2644 | chr1 | ENST00000347310.9 |
| IL24 | AATTCAAAAACACAGGCGGTTTCTGCTATTCCTCGAGGAATAGCAGAAACCGCCTGTG | 2645 | chr1 | ENST00000294984.6 |
| IL24 | AATTCAAAAAGTCAGGACTCTGAAGTCATTCCTCGAGGAATGACTTCAGAGTCCTGAC | 2646 | chr1 | ENST00000294984.6 |
| IL24 | AATTCAAAAATCGGATGCTGAGAGCTGTTACCTCGAGGTAACAGCTCTCAGCATCCGA | 2647 | chr1 | ENST00000294984.6 |
| IL25 | AATTCAAAAACAGGCACTTTCTAGATATTTCTCGAGAAATATCTAGAAAGTGCCTGT | 2648 | chr14 | ENST00000329715.2 |
| IL25 | AATTCAAAAACCACAACCAGACTGTCTTCTACTCGAGTAGAAGACAGTCTGGTTGTGG | 2649 | chr14 | ENST00000329715.2 |
| IL25 | AATTCAAAAATCCTGTAGGGCCAGTGAAGATCTCGAGATCTTCACTGGCCCTACAGGA | 2650 | chr14 | ENST00000329715.2 |
| IL26 | AATTCAAAAAGCTGTTGACGCTCTCTATATCTCGAGATATAGAGAGCGTCAACAGCT | 2651 | chr12 | ENST00000229134.4 |
| IL26 | AATTCAAAAAGTACATTGTGTCAACTTAATCTCGAGATTAAGTTGACACAATGTACT | 2652 | chr12 | ENST00000229134.4 |
| IL26 | AATTCAAAAACGATTCCAGAAGACCGCATAACTCGAGTTATGCGGTCTTCTGGAATCG | 2653 | chr12 | ENST00000229134.4 |
| IL27 | AATTCAAAAACTCCTTGGAGCTCGTCTTATCTCGAGATAAGACGAGCTCCAAGGAGT | 2654 | chr16 | ENST00000356897.1 |
| IL27 | AATTCAAAAACTTTAGGACTGGAGTCTTGGCTCGAGCCAAGACTCCAGTCCTAAAGT | 2655 | chr16 | ENST00000356897.1 |
| IL27 | AATTCAAAAACATCATCAGCCTTGGACAAGGCTCGAGCCTTGTCCAAGGCTGATGATG | 2656 | chr16 | ENST00000356897.1 |

TABLE 16-continued

3' to 5' (Reverse) shRNA sequences for Silencing of Cytokine/Chemokine
Genes to Reduce the Incidence of CRS

| Target Gene Symbol | shRNA Reverse Oligo Sequence | SEQ ID NO: | Location | Gene ID No. |
|---|---|---|---|---|
| IL2RA | AATTCAAAAACCTCGTCACAACAACAGATTTCTCGAGAAATCTGTTGTTGTGACGAGG | 2657 | chr10 | ENST00000379959.7 |
| IL2RA | AATTCAAAAACCCTATACAACTGGACATTGCTCGAGCAATGTCCAGTTGTATAGGGT | 2658 | chr10 | ENST00000379959.7 |
| IL2RA | AATTCAAAAACTCGGAACACAACGAAACAACTCGAGTTGTTTCGTTGTGTTCCGAGT | 2659 | chr10 | ENST00000379959.7 |
| IL2RB | AATTCAAAAAGTCCCAGACCTGGTGGATTTCTCGAGAAATCCACCAGGTCTGGGACT | 2660 | chr22 | ENST00000216223.9 |
| IL2RB | AATTCAAAAAGACCCACAGATGCAACATAAGCTCGAGCTTATGTTGCATCTGTGGGTC | 2661 | chr22 | ENST00000216223.9 |
| IL2RB | AATTCAAAAACCAGACACCCAGTATGAGTTTCTCGAGAAACTCATACTGGGTGTCTGG | 2662 | chr22 | ENST00000216223.9 |
| IL2RG | AATTCAAAAATCGTGTTCGGAGCCGCTTTAACTCGAGTTAAAGCGGCTCCGAACACGA | 2663 | chrX | ENST00000374202.6 |
| IL2RG | AATTCAAAAACCAACCTCACTCTGCATTATTCTCGAGAATAATGCAGAGTGAGGTTGG | 2664 | chrX | ENST00000374202.6 |
| IL2RG | AATTCAAAAATTGGCTCCATGGGATTGATTACTCGAGTAATCAATCCCATGGAGCCAA | 2665 | chrX | ENST00000374202.6 |
| IL3 | AATTCAAAAATTATCCCATTGAGACTATTTACTCGAGTAAATAGTCTCAATGGGATAA | 2666 | chr5 | ENST00000296870.2 |
| IL3 | AATTCAAAAACGGCATCAGATGAATTGTTAACTCGAGTTAACAATTCATCTGATGCCG | 2667 | chr5 | ENST00000296870.2 |
| IL3 | AATTCAAAAAGCAATTGAGAGCATTCTTAAACTCGAGTTTAAGAATGCTCTCAATTGC | 2668 | chr5 | ENST00000296870.2 |
| IL31 | AATTCAAAAAGCATATCTCAAGACAATCAGACTCGAGTCTGATTGTCTTGAGATATGC | 2669 | chr12 | ENST00000377035.1 |
| IL31 | AATTCAAAAACCAAGTGATGATGTACAGAAACTCGAGTTTCTGTACATCATCACTTGG | 2670 | chr12 | ENST00000377035.1 |
| IL31 | AATTCAAAAACCTGACTATTTCTCAACAGTTCTCGAGAACTGTTGAGAAATAGTCAGG | 2671 | chr12 | ENST00000377035.1 |
| IL31RA | AATTCAAAAACATCAAACGAATGATTCAAATCTCGAGATTTGAATCATTCGTTTGATG | 2672 | chr5 | ENST00000447346.6 |
| IL31RA | AATTCAAAAACGCCTGTTTCATCTGATTTAACTCGAGTTAAATCAGATGAAACAGGCG | 2673 | chr5 | ENST00000447346.6 |
| IL31RA | AATTCAAAAATTTCCTGTGTCTACTACTATACTCGAGTATAGTAGTAGACACAGGAAA | 2674 | chr5 | ENST00000447346.6 |
| IL32 | AATTCAAAAATGTCGCCCTGGCATCTTAATACTCGAGTATTAAGATGCCAGGGCGACA | 2675 | chr16 | ENST00000325568.9 |
| IL32 | AATTCAAAAAGAGCTCACTCCTCTACTTGACTCGAGTCAAGTAGAGGAGTGAGCTCT | 2676 | chr16 | ENST00000325568.9 |
| IL32 | AATTCAAAAAGAGCTGGAGGACGACTTCAACTCGAGTTGAAGTCGTCCTCCAGCTCT | 2677 | chr16 | ENST00000325568.9 |
| IL33 | AATTCAAAAAGAGTGCTTTGCCTTTGGTATACTCGAGTATACCAAAGGCAAAGCACTC | 2678 | chr9 | ENST00000381434.7 |
| IL33 | AATTCAAAAAGCACTCCAACTGTGTTTCATTCTCGAGAATGAAACACAGTTGGAGTGC | 2679 | chr9 | ENST00000381434.7 |
| IL33 | AATTCAAAAACCTGTTACTTTAGGAGAGAAACTCGAGTTTCTCTCCTAAAGTAACAGG | 2680 | chr9 | ENST00000381434.7 |
| IL34 | AATTCAAAAAGCCGACTTCAGTACATGAAACCTCGAGGTTTCATGTACTGAAGTCGGC | 2681 | chr16 | ENST00000288098.6 |
| IL34 | AATTCAAAAACAGAGCCCTCATTGCAGTATGCTCGAGCATACTGCAATGAGGGCTCTG | 2682 | chr16 | ENST00000288098.6 |
| IL34 | AATTCAAAAACCGTGTTGTCCCTCTTGAATGCTCGAGCATTCAAGAGGGACAACACG | 2683 | chr16 | ENST00000288098.6 |
| IL36A | AATTCAAAAACTCCAGTCACTATTGCCTTAACTCGAGTTAAGGCAATAGTGACTGGAG | 2684 | chr2 | ENST00000259211.6 |
| IL36A | AATTCAAAAATTCAGGACCAGACGCTCATAGCTCGAGCTATGAGCGTCTGGTCCTGAA | 2685 | chr2 | ENST00000259211.6 |
| IL36A | AATTCAAAAACTCTGCCTGATGTGTGCTAAACTCGAGTTTAGCACACATCAGGCAGAG | 2686 | chr2 | ENST00000259211.6 |
| IL36B | AATTCAAAAATCCTATGCTATTCGTGATTCCTCGAGGAATCACGAATAGCATAGGAT | 2687 | chr2 | ENST00000327407.2 |
| IL36B | AATTCAAAAACCTGAGTGGAAATTCTTTAATCTCGAGATTAAAGAATTTCCACTCAGG | 2688 | chr2 | ENST00000327407.2 |
| IL36B | AATTCAAAAATTGGACTACATAACCTGTAAACTCGAGTTTACAGGTTATGTAGTCCAA | 2689 | chr2 | ENST00000327407.2 |
| IL36G | AATTCAAAAATGATATCATCCAGTCTTTATACTCGAGTATAAAGACTGGATGATATCA | 2690 | chr2 | ENST00000259205.4 |
| IL36G | AATTCAAAAACAGGAGAGCTGGGTGGTATAACTCGAGTTATACCACCCAGCTCTCCTG | 2691 | chr2 | ENST00000259205.4 |
| IL36G | AATTCAAAAAGGGAATCCAGAATCCAGAAATCTCGAGATTTCTGGATTCTGGATTCCC | 2692 | chr2 | ENST00000259205.4 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| IL36RN | AATTCAAAAACTCGGCATTGAAGGTGCTTTACTCGAGTAAAGCACCTTCAATGCCGAG | 2693 | chr2 | ENST00000346807.7 |
| IL36RN | AATTCAAAAATGGTTCCCAGTTTGGATAAATCTCGAGATTTATCCAAACTGGGAACCA | 2694 | chr2 | ENST00000346807.7 |
| IL36RN | AATTCAAAAAGGGAATCATTCCTGCTTAATGCTCGAGCATTAAGCAGGAATGATTCCC | 2695 | chr2 | ENST00000346807.7 |
| IL37 | AATTCAAAAACTCTACTGTGACAAGGATAAACTCGAGTTTATCCTTGTCACAGTAGAG | 2696 | chr2 | ENST00000263326.7 |
| IL37 | AATTCAAAAATGCACCTCCTGCAATTGTAATCTCGAGATTACAATTGCAGGAGGTGCA | 2697 | chr2 | ENST00000263326.7 |
| IL37 | AATTCAAAAAGTTCACACAAAGATCTTCTTTCTCGAGAAAGAAGATCTTTGTGTGAAC | 2698 | chr2 | ENST00000263326.7 |
| IL4 | AATTCAAAAAGCTGATCCGATTCCTGAAACCTCGAGGTTTCAGGAATCGGATCAGCT | 2699 | chr5 | ENST00000231449.6 |
| IL4 | AATTCAAAAACCACGGACACAAGTGCGATATCTCGAGATATCGCACTTGTGTCCGTGG | 2700 | chr5 | ENST00000231449.6 |
| IL4 | AATTCAAAAATAGCATGTGCCGGCAACTTTGCTCGAGCAAAGTTGCCGGCACATGCTA | 2701 | chr5 | ENST00000231449.6 |
| IL5 | AATTCAAAAAGCAAGAGTTTCTTGGTGTAATCTCGAGATTACACCAAGAAACTCTTGC | 2702 | chr5 | ENST00000231454.5 |
| IL5 | AATTCAAAAAGGGTACTGTGGAAAGACTATTCTCGAGAATAGTCTTTCCACAGTACCC | 2703 | chr5 | ENST00000231454.5 |
| IL5 | AATTCAAAAAGAAAGAGTCAGGCCTTAATTTCTCGAGAAATTAAGGCCTGACTCTTTC | 2704 | chr5 | ENST00000231454.5 |
| IL6 | AATTCAAAAAATGAGCGTTAGGACACTATTTCTCGAGAAATAGTGTCCTAACGCTCAT | 2705 | chr7 | ENST00000258743.9 |
| IL6 | AATTCAAAAAGAGTACCTCCAGAACAGATTTCTCGAGAAATCTGTTCTGGAGGTACTC | 2706 | chr7 | ENST00000258743.9 |
| IL6 | AATTCAAAAATGTGAAGCTGAGTTAATTTACTCGAGTAAATTAACTCAGCTTCACAT | 2707 | chr7 | ENST00000258743.9 |
| IL6R | AATTCAAAAAGCAGGCACTTACTACTAATAACTCGAGTTATTAGTAGTAAGTGCCTGC | 2708 | chr1 | ENST00000368485.7 |
| IL6R | AATTCAAAAATATCGGGCTGAACGGTCAAAGCTCGAGCTTTGACCGTTCAGCCCGATA | 2709 | chr1 | ENST00000368485.7 |
| IL6R | AATTCAAAAACTGGACCCTGTGGATGATAAACTCGAGTTTATCATCCACAGGGTCCAG | 2710 | chr1 | ENST00000368485.7 |
| IL6ST | AATTCAAAAACCGTGCATCGCACCTATTTACTCGAGTAAATAGGTGCGATGCACGGT | 2711 | chr5 | ENST00000336909.9 |
| IL6ST | AATTCAAAAACTTCAGCAGTACCTATAAAGCTCGAGCTTTATAGGTACTGCTGAAGT | 2712 | chr5 | ENST00000336909.9 |
| IL6ST | AATTCAAAAACGGCCAGAAGATCTACAATTACTCGAGTAATTGTAGATCTTCTGGCCG | 2713 | chr5 | ENST00000336909.9 |
| IL7 | AATTCAAAAAGCTCGCAAGTTGAGGCAATTTCTCGAGAAATTGCCTCAACTTGCGAGC | 2714 | chr8 | ENST00000263851.8 |
| IL7 | AATTCAAAAAGCTCACTATGAATCTATTATACTCGAGTATAATAGATTCATAGTGAGC | 2715 | chr8 | ENST00000263851.8 |
| IL7 | AATTCAAAAAGTGTTTCCTAAAGAGACTATTCTCGAGAATAGTCTCTTTAGGAAACAC | 2716 | chr8 | ENST00000263851.8 |
| IL9 | AATTCAAAAACCACCATGCAAACAAGATACCTCGAGGTATCTTGTTTGCATGGTGGT | 2717 | chr5 | ENST00000274520.1 |
| IL9 | AATTCAAAAAGAACAACAAGTGTCCATATTTCTCGAGAAATATGGACACTTGTTGTTC | 2718 | chr5 | ENST00000274520.1 |
| IL9 | AATTCAAAAACTGAAGAGTCTTCTGGAAATTCTCGAGAATTTCCAGAAGACTCTTCAG | 2719 | chr5 | ENST00000274520.1 |
| INHA | AATTCAAAAACCTCGGATGGAGGTTACTCTTCTCGAGAAGAGTAACCTCCATCCGAGG | 2720 | chr2 | ENST00000243786.2 |
| INHA | AATTCAAAAAGCAGCACTGTGCTTGTATCTACTCGAGTAGATACAAGCACAGTGCTGC | 2721 | chr2 | ENST00000243786.2 |
| INHA | AATTCAAAAATGGAGGTTACTCTTTCAAGTACTCGAGTACTTGAAAGAGTAACCTCCA | 2722 | chr2 | ENST00000243786.2 |
| INHBA | AATTCAAAAAGGCACTTTCCTACCCAATTACTCGAGTAATTGGGTAGGAAAGTGCCT | 2723 | chr7 | ENST00000242208.4 |
| INHBA | AATTCAAAAAGAGAATGGTGTACCCTTTATTCTCGAGAATAAAGGGTACACCATTCTC | 2724 | chr7 | ENST00000242208.4 |
| INHBA | AATTCAAAAAGACGCTGCACTTCGAGATTTCTCGAGAAATCTCGAAGTGCAGCGTCT | 2725 | chr7 | ENST00000242208.4 |
| INHBB | AATTCAAAAACAAATGGATGCGGTGACAAATCTCGAGATTTGTCACCGCATCCATTTG | 2726 | chr2 | ENST00000295228.3 |
| INHBB | AATTCAAAAAGCTGGAACGACTGGATCATAGCTCGAGCTATGATCCAGTCGTTCCAGC | 2727 | chr2 | ENST00000295228.3 |
| INHBB | AATTCAAAAATGATGAGTACAACATCGTCAACTCGAGTTGACGATGTTGTACTCATCA | 2728 | chr2 | ENST00000295228.3 |
| INHBC | AATTCAAAAATCAACCAGACTCGTCTTGATTCTCGAGAATCAAGACGAGTCTGGTTGA | 2729 | chr12 | ENST00000309668.2 |

TABLE 16-continued

3' to 5' (Reverse) shRNA sequences for Silencing of Cytokine/Chemokine
Genes to Reduce the Incidence of CRS

| Target Gene Symbol | shRNA Reverse Oligo Sequence | SEQ ID NO: | Location | Gene ID No. |
|---|---|---|---|---|
| INHBC | AATTCAAAAACAAGACTGACATACCTGACATCTCGAGATGTCAGGTATGTCAGTCTTG | 2730 | chr12 | ENST00000309668.2 |
| INHBC | AATTCAAAAACAGGCCAGTCTCATGTTCTTTCTCGAGAAAGAACATGAGACTGGCCTG | 2731 | chr12 | ENST00000309668.2 |
| INHBE | AATTCAAAAACTCCTCTACCTGGATCATAATCTCGAGATTATGATCCAGGTAGAGGAG | 2732 | chr12 | ENST00000266646.2 |
| INHBE | AATTCAAAAACCTGGGCTGGCATACCTTAACTCGAGTTAAGGTATGCCAGCCCAGGT | 2733 | chr12 | ENST00000266646.2 |
| INHBE | AATTCAAAAAGCAGCCCTTCCTAGAGCTTAACTCGAGTTAAGCTCTAGGAAGGGCTGC | 2734 | chr12 | ENST00000266646.2 |
| ITGA4 | AATTCAAAAACCAACGCTTCAGTGATCAATCCTCGAGGATTGATCACTGAAGCGTTGG | 2735 | chr2 | ENST00000397033.6 |
| ITGA4 | AATTCAAAAATGTAGAACACATCAAGCATTTCTCGAGAAATGCTTGATGTGTTCTACA | 2736 | chr2 | ENST00000397033.6 |
| ITGA4 | AATTCAAAAACATGATCTTGTGACATATTATCTCGAGATAATATGTCACAAGATCATG | 2737 | chr2 | ENST00000397033.6 |
| ITGAV | AATTCAAAAATTGAAGTGTACCCTAGCATTTCTCGAGAAATGCTAGGGTACACTTCAA | 2738 | chr2 | ENST00000261023.7 |
| ITGAV | AATTCAAAAACACTCCAAGAACATGACTATTCTCGAGAATAGTCATGTTCTTGGAGTG | 2739 | chr2 | ENST00000261023.7 |
| ITGAV | AATTCAAAAAGTGAGGTCGAAACAGGATAAACTCGAGTTTATCCTGTTTCGACCTCAC | 2740 | chr2 | ENST00000261023.7 |
| ITGB1 | AATTCAAAAATTTGTAGGAAGAGGGATAATACTCGAGTATTATCCCTCTTCCTACAAA | 2741 | chr10 | ENST00000302278.7 |
| ITGB1 | AATTCAAAAAGCCTTGCATTACTGCTGATATCTCGAGATATCAGCAGTAATGCAAGGC | 2742 | chr10 | ENST00000302278.7 |
| ITGB1 | AATTCAAAAAGCCTTGCATTACTGCTGATATCTCGAGATATCAGCAGTAATGCAAGGC | 2743 | chr10 | ENST00000302278.7 |
| ITGB3 | AATTCAAAAAGTCGTCAGATTCCAGTACTATCTCGAGATAGTACTGGAATCTGACGAC | 2744 | chr17 | ENST00000559488.5 |
| ITGB3 | AATTCAAAAAGTCGTCAGATTCCAGTACTATCTCGAGATAGTACTGGAATCTGACGAC | 2745 | chr17 | ENST00000559488.5 |
| ITGB3 | AATTCAAAAACCACGTCTACCTTCACCAATACTCGAGTATTGGTGAAGGTAGACGTGG | 2746 | chr17 | ENST00000559488.5 |
| KIT | AATTCAAAAAACTTCATCTAACGAGATTAAACTCGAGTTTAATCTCGTTAGATGAAGT | 2747 | chr4 | ENST00000288135.5 |
| KIT | AATTCAAAAAGCGACGAGATTAGGCTGTTATCTCGAGATAACAGCCTAATCTCGTCGC | 2748 | chr4 | ENST00000288135.5 |
| KIT | AATTCAAAAACGAGTTGGCCCTAGACTTAGCTCGAGCTAAGTCTAGGGCCAACTCGT | 2749 | chr4 | ENST00000288135.5 |
| KITLG | AATTCAAAAAGCAGGAATCGTGTGACTAATACTCGAGTATTAGTCACACGATTCCTGC | 2750 | chr12 | ENST00000228280.9 |
| KITLG | AATTCAAAAAGCAGGAATCGTGTGACTAATACTCGAGTATTAGTCACACGATTCCTGC | 2751 | chr12 | ENST00000228280.9 |
| KITLG | AATTCAAAAACCTATTTAATCCTCTCGTCAACTCGAGTTGACGAGAGGATTAAATAGG | 2752 | chr12 | ENST00000228280.9 |
| KLHL20 | AATTCAAAAAGCCAATACATGGAGGTTATATCTCGAGATATAACCTCCATGTATTGGC | 2753 | chr1 | ENST00000209884.4 |
| KLHL20 | AATTCAAAAAGCCGCAAGAACGACCACTAATCTCGAGATTAGTGGTCGTTCTTGCGGC | 2754 | chr1 | ENST00000209884.4 |
| KLHL20 | AATTCAAAAACACATTGTGAATCCCATATTTCTCGAGAAATATGGGATTCACAATGTG | 2755 | chr1 | ENST00000209884.4 |
| LEFTY1 | AATTCAAAAACAAGTTACCTCACCTAATTTCTCGAGAAATTAGGTGAGGTAACTTGT | 2756 | chr1 | ENST00000272134.5 |
| LEFTY1 | AATTCAAAAAGCCCAATGTGTCATTGTTTACTCGAGTAAACAATGACACATTGGGCT | 2757 | chr1 | ENST00000272134.5 |
| LEFTY1 | AATTCAAAAATCTCTAGTGAGCCCTGAATTTCTCGAGAAATTCAGGGCTCACTAGAGA | 2758 | chr1 | ENST00000272134.5 |
| LEFTY2 | AATTCAAAAAGTTACTCCATCCCAATTTAGCTCGAGCTAAATTGGGATGGAGTAACT | 2759 | chr1 | ENST00000366820.9 |
| LEFTY2 | AATTCAAAAACTAAGCACTTACGTGAGTAAACTCGAGTTTACTCACGTAAGTGCTTAG | 2760 | chr1 | ENST00000366820.9 |
| LEFTY2 | AATTCAAAAATAGGCGCCTGGTGTATCCATTCTCGAGAATGGATACACCAGGCGCCTA | 2761 | chr1 | ENST00000366820.9 |
| LIF | AATTCAAAAAGCAGTGCCAATGCCCTCTTTACTCGAGTAAAGAGGGCATTGGCACTGC | 2762 | chr22 | ENST00000249075.3 |
| LIF | AATTCAAAAACCGCATAGTCGTGTACCTTGCTCGAGCAAGGTACACGACTATGCGGT | 2763 | chr22 | ENST00000249075.3 |
| LIF | AATTCAAAAACAACAACCTGGACAAGCTATGCTCGAGCATAGCTTGTCCAGGTTGTTG | 2764 | chr22 | ENST00000249075.3 |
| LIFR | AATTCAAAAATGACTTGCGACTACGTCATTACTCGAGTAATGACGTAGTCGCAAGTCA | 2765 | chr5 | ENST00000263409.8 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| LIFR | AATTCAAAAACTTCTGCAGATTCGATATTACTCGAGTAATATCGAATCTGCAGAAGT | 2766 | chr5 | ENST00000263409.8 |
| LIFR | AATTCAAAAAGTAGGCTCAGACATAACATTTCTCGAGAAATGTTATGTCTGAGCCTAC | 2767 | chr5 | ENST00000263409.8 |
| LTA | AATTCAAAAAGCCCTAGTACTGTCTTCTTTGCTCGAGCAAAGAAGACAGTACTAGGGC | 2768 | chr6 | ENST00000418386.2 |
| LTA | AATTCAAAAAGATCAAGTCACCGGAGCTTTCCTCGAGGAAAGCTCCGGTGACTTGATC | 2769 | chr6 | ENST00000418386.2 |
| LTA | AATTCAAAAAGCTCCCAGAAGATGGTGTATCCTCGAGGATACACCATCTTCTGGGAGC | 2770 | chr6 | ENST00000418386.2 |
| LTB | AATTCAAAAAGCGAGAGGGAAGACCTTCTTTCTCGAGAAAGAAGGTCTTCCCTCTCGC | 2771 | chr6 | ENST00000429299.2 |
| LTB | AATTCAAAAACGAGAGGGTGTACGTCAACATCTCGAGATGTTGACGTACACCCTCTCG | 2772 | chr6 | ENST00000429299.2 |
| LTB | AATTCAAAAAGACGAAGGAACAGGCGTTTCTCTCGAGAGAAACGCCTGTTCCTTCGTC | 2773 | chr6 | ENST00000429299.2 |
| LTBP1 | AATTCAAAAAGATGACCTGTGTCGATGTAAACTCGAGTTTACATCGACACAGGTCATC | 2774 | chr2 | ENST00000407925.5 |
| LTBP1 | AATTCAAAAAGGTGGAACAGTGCTGTTATTTCTCGAGAAATAACAGCACTGTTCCACC | 2775 | chr2 | ENST00000407925.5 |
| LTBP1 | AATTCAAAAACCGTTGAATACCGCCTTGAATCTCGAGATTCAAGGCGGTATTCAACGG | 2776 | chr2 | ENST00000407925.5 |
| LTBP3 | AATTCAAAAAGCATCCTCAATGGATGTGAAACTCGAGTTTCACATCCATTGAGGATGC | 2777 | chr11 | ENST00000322147.8 |
| LTBP3 | AATTCAAAAATGTTGTTCGGGTCGGAGATTTCTCGAGAAATCTCCGACCCGAACAACA | 2778 | chr11 | ENST00000322147.8 |
| LTBP3 | AATTCAAAAAAGCGCTTCAAGGTGGTCTTTGCTCGAGCAAAGACCACCTTGAAGCGCT | 2779 | chr11 | ENST00000322147.8 |
| LTBP4 | AATTCAAAAAGCTTCGACATGCCAGACTTTGCTCGAGCAAAGTCTGGCATGTCGAAGC | 2780 | chr19 | ENST00000308370.11 |
| LTBP4 | AATTCAAAAATGAAACACTACAGGGTGTATGCTCGAGCATACACCCTGTAGTGTTTCA | 2781 | chr19 | ENST00000308370.11 |
| LTBP4 | AATTCAAAAACAACCGGCTTTGAAAGAGTTACTCGAGTAACTCTTTCAAAGCCGGTTG | 2782 | chr19 | ENST00000308370.11 |
| MAF | AATTCAAAAATCAGTGGGATACGCCACATTTCTCGAGAAATGTGGCGTATCCCACTGA | 2783 | chr16 | ENST00000326043.4 |
| MAF | AATTCAAAAATTTATGGTGTGTGCAAGTAAACTCGAGTTTACTTGCACACACCATAAA | 2784 | chr16 | ENST00000326043.4 |
| MAF | AATTCAAAAAGTTAGAGAAGAAGGCTATTAACTCGAGTTAATAGCCTTCTTCTCTAAC | 2785 | chr16 | ENST00000326043.4 |
| MAF | AATTCAAAAATGTTAATGACTTCGATCTGATCTCGAGATCAGATCGAAGTCATTAACA | 2786 | chr16 | ENST00000326043.4 |
| MIF | AATTCAAAAACTACATCAACTATTACGACATCTCGAGATGTCGTAATAGTTGATGTAG | 2787 | chr22 | ENST00000215754.7 |
| MIF | AATTCAAAAACTACATCAACTATTACGACATCTCGAGATGTCGTAATAGTTGATGTAG | 2788 | chr22 | ENST00000215754.7 |
| MIF | AATTCAAAAAGACAGGGTCTACATCAACTATCTCGAGATAGTTGATGTAGACCCTGTC | 2789 | chr22 | ENST00000215754.7 |
| MINOS1- | AATTCAAAAAGCCAAGCTGCACAATTTAATACTCGAGTATTAAATTGTGCAGCTTGGC | 2790 | chr1 | ENST00000602662.1 |
| MINOS1- | AATTCAAAAAGCTGGCACTGTTCCCAGATAACTCGAGTTATCTGGGAACAGTGCCAGC | 2791 | chr1 | ENST00000602662.1 |
| MINOS1- | AATTCAAAAAGAAAGACCACTGGCAGAAACCTCGAGGTTTCTGCCAGTGGTCTTTCT | 2792 | chr1 | ENST00000602662.1 |
| MSTN | AATTCAAAAAGGCCCAACTATGGATATATTCTCGAGAATATATCCATAGTTGGGCCT | 2793 | chr2 | ENST00000260950.4 |
| MSTN | AATTCAAAAAGAGCTAGAAGGAGATCAAATTCTCGAGAATTTGATCTCCTTCTAGCTC | 2794 | chr2 | ENST00000260950.4 |
| MSTN | AATTCAAAAAGTATGCTTTAAAGTCTATTTCCTCGAGGAAATAGACTTTAAAGCATAC | 2795 | chr2 | ENST00000260950.4 |
| NAMPT | AATTCAAAAAGCGATAGCTATGACATTTATCTCGAGATAAATGTCATAGCTATCGCT | 2796 | chr7 | ENST00000222553.7 |
| NAMPT | AATTCAAAAAGTGAAGATCTAAGACATTTAACTCGAGTTAAATGTCTTAGATCTTCAC | 2797 | chr7 | ENST00000222553.7 |
| NAMPT | AATTCAAAAATACAAGGTTACTCACTATAAACTCGAGTTTATAGTGAGTAACCTTGTA | 2798 | chr7 | ENST00000222553.7 |
| NBL1 | AATTCAAAAAGCCAAGCTGCACAATTTAATACTCGAGTATTAAATTGTGCAGCTTGGC | 2799 | chr1 | ENST00000375136.7 |
| NBL1 | AATTCAAAAAGCTGGCACTGTTCCCAGATAACTCGAGTTATCTGGGAACAGTGCCAGC | 2800 | chr1 | ENST00000375136.7 |
| NBL1 | AATTCAAAAAGAAAGACCACTGGCAGAAACCTCGAGGTTTCTGCCAGTGGTCTTTCT | 2801 | chr1 | ENST00000375136.7 |
| NDP | AATTCAAAAACTGCTAAAGGTTACCGATTTCCTCGAGGAAATCGGTAACCTTTAGCAG | 2802 | chrX | ENST00000378062.5 |

TABLE 16-continued

3' to 5' (Reverse) shRNA sequences for Silencing of Cytokine/Chemokine
Genes to Reduce the Incidence of CRS

| Target Gene Symbol | shRNA Reverse Oligo Sequence | SEQ ID NO: | Location | Gene ID No. |
|---|---|---|---|---|
| NDP | AATTCAAAAACTCTGCATATTCTAGTAATAACTCGAGTTATTACTAGAATATGCAGAG | 2803 | chrX | ENST00000378062.5 |
| NDP | AATTCAAAAACGGACAGCTCATTCATAATGCTCGAGCATTATGAATGAGCTGTCCGT | 2804 | chrX | ENST00000378062.5 |
| NLRP7 | AATTCAAAAACCGTTCAAGGAAATTTCTATTCTCGAGAATAGAAATTTCCTTGAACGG | 2805 | chr19 | ENST00000328092.9 |
| NLRP7 | AATTCAAAAACGGGTCTCTAAGATGTCTTATCTCGAGATAAGACATCTTAGAGACCCG | 2806 | chr19 | ENST00000328092.9 |
| NLRP7 | AATTCAAAAACCTGCTCAGAAATCATAAATCTCGAGATTTATGATTTCTGAGCAGGT | 2807 | chr19 | ENST00000328092.9 |
| NODAL | AATTCAAAAAGTGCTCCTAGATCACCATAAACTCGAGTTTATGGTGATCTAGGAGCAC | 2808 | chr10 | ENST00000287139.7 |
| NODAL | AATTCAAAAACACCTATAGCTTTCATGTATTCTCGAGAATACATGAAAGCTATAGGTG | 2809 | chr10 | ENST00000287139.7 |
| NODAL | AATTCAAAAAGCATGCTGTATGTGGATAATGCTCGAGCATTATCCACATACAGCATGC | 2810 | chr10 | ENST00000287139.7 |
| NOG | AATTCAAAAAGGTCAGTATTATACGTTAAACTCGAGTTTAACGTATAATACTGACCT | 2811 | chr17 | ENST00000332822.4 |
| NOG | AATTCAAAAAATTCTGGTTGTTGCTAATAATCTCGAGATTATTAGCAACAACCAGAAT | 2812 | chr17 | ENST00000332822.4 |
| NOG | AATTCAAAAATGCGGAGGAAGTTACAGATGTCTCGAGACATCTGTAACTTCCTCCGCA | 2813 | chr17 | ENST00000332822.4 |
| NRG1 | AATTCAAAAAGATATACAGAGGCCTATAACCTCGAGGTTATAGGCCTCTGTGATATC | 2814 | chr8 | ENST00000287842.7 |
| NRG1 | AATTCAAAAAGGCTGATTCTGGAGAGTATATCTCGAGATATACTCTCCAGAATCAGCC | 2815 | chr8 | ENST00000287842.7 |
| NRG1 | AATTCAAAAAGACAGTGCCTCTGCCAATATCCTCGAGGATATTGGCAGAGGCACTGTC | 2816 | chr8 | ENST00000287842.7 |
| NRP1 | AATTCAAAAATATACTAGAATCACCGCATTTCTCGAGAAATGCGGTGATTCTAGTATA | 2817 | chr10 | ENST00000265371.8 |
| NRP1 | AATTCAAAAACAGCCTTGAATGCACTTATATCTCGAGATATAAGTGCATTCAAGGCTG | 2818 | chr10 | ENST00000265371.8 |
| NRP1 | AATTCAAAAACAGCCTTGAATGCACTTATATCTCGAGATATAAGTGCATTCAAGGCTG | 2819 | chr10 | ENST00000265371.8 |
| NRP2 | AATTCAAAAACGACTGCAAGTATGACTTTATCTCGAGATAAAGTCATACTTGCAGTCG | 2820 | chr2 | ENST00000357785.9 |
| NRP2 | AATTCAAAAACCGGATTGCTAATGAACAGATCTCGAGATCTGTTCATTAGCAATCCGG | 2821 | chr2 | ENST00000357785.9 |
| NRP2 | AATTCAAAAACCTCAACTTCAACCCTCACTTCTCGAGAAGTGAGGGTTGAAGTTGAGG | 2822 | chr2 | ENST00000357785.9 |
| OSM | AATTCAAAAACTTCCTCCTTTCCGTGTTTCCTCGAGGAAACACGGAAAGGAGGAAGT | 2823 | chr22 | ENST00000215781.2 |
| OSM | AATTCAAAAAGGACCGACTTTCCATTGATTCCTCGAGGAATCAATGGAAAGTCGGTCC | 2824 | chr22 | ENST00000215781.2 |
| OSM | AATTCAAAAATGGTCCTTGCACTCCTGTTTCCTCGAGGAAACAGGAGTGCAAGGACCA | 2825 | chr22 | ENST00000215781.2 |
| OSMR | AATTCAAAAATAACCTGACTCATCGAGTTTACTCGAGTAAACTCGATGAGTCAGGTTA | 2826 | chr5 | ENST00000274276.7 |
| OSMR | AATTCAAAAAGGAGAACCCTCACCTAATAACTCGAGTTATTAGGTGAGGGTTCTCCT | 2827 | chr5 | ENST00000274276.7 |
| OSMR | AATTCAAAAAGCACTCCATAAGGAATAATTTCTCGAGAAATTATTCCTTATGGAGTGC | 2828 | chr5 | ENST00000274276.7 |
| PARK7 | AATTCAAAAAGTAGCCGTGATGTGGTCATTTCTCGAGAAATGACCACATCACGGCTAC | 2829 | chr1 | ENST00000338639.9 |
| PARK7 | AATTCAAAAAGCAATTGTTGAAGCCCTGAATCTCGAGATTCAGGGCTTCAACAATTGC | 2830 | chr1 | ENST00000338639.9 |
| PARK7 | AATTCAAAAACTCTGAGAATCGTGTGGAAACTCGAGTTTCCACACGATTCTCAGAGT | 2831 | chr1 | ENST00000338639.9 |
| PDPN | AATTCAAAAAGCCTCTGGTATGAGAAATAAACTCGAGTTTATTTCTCATACCAGAGGC | 2832 | chr1 | ENST00000294489.10 |
| PDPN | AATTCAAAAAGTCCACGCGCAAGAACAAAGCTCGAGCTTTGTTCTTGCGCGTGGACT | 2833 | chr1 | ENST00000294489.10 |
| PDPN | AATTCAAAAATGACCCTGGTTGGAATCATAGCTCGAGCTATGATTCCAACCAGGGTCA | 2834 | chr1 | ENST00000294489.10 |
| PF4 | AATTCAAAAACGCTGAAGAATGGAAGGAACTCGAGTTTCCTTCCATTCTTCAGCGT | 2835 | chr4 | ENST00000296029.3 |
| PF4 | AATTCAAAAACCAACTGATAGCCACGCTGAACCTCGAGTTCAGCGTGGCTATCAGTTGG | 2836 | chr4 | ENST00000296029.3 |
| PF4 | AATTCAAAAACACGCTGAAGAATGGAAGGAACTCGAGTTCCTTCCATTCTTCAGCGTG | 2837 | chr4 | ENST00000296029.3 |
| PF4V1 | AATTCAAAAAGTTGTGGTATAGTCAATCTATCTCGAGATAGATTGACTATACCACAAC | 2838 | chr4 | ENST00000226524.3 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| PF4V1 | AATTCAAAAAGCTGCCTAAGTGTGCACTTTCTCGAGAAAGTGCACACTTAGGCAGCT | 2839 | chr4 | ENST00000226524.3 |
| PF4V1 | AATTCAAAAACTGACACATCACAATTTCATACTCGAGTATGAAATTGTGATGTGTCAG | 2840 | chr4 | ENST00000226524.3 |
| PGLYRP1 | AATTCAAAAAGTGCCCACTCAGGTCACTTATCTCGAGATAAGTGACCTGAGTGGGCAC | 2841 | chr19 | ENST00000008938.4 |
| PGLYRP1 | AATTCAAAAACTTACGCTATGTGGTGGTATCCTCGAGGATACCACCACATAGCGTAAG | 2842 | chr19 | ENST00000008938.4 |
| PGLYRP1 | AATTCAAAAACATCAGCTTCATGGGCAACTACTCGAGTAGTTGCCCATGAAGCTGATG | 2843 | chr19 | ENST00000008938.4 |
| PLP2 | AATTCAAAAACCTGTCGGTGATTGAGATGATCTCGAGATCATCTCAATCACCGACAGG | 2844 | chrX | ENST00000376327.5 |
| PLP2 | AATTCAAAAACCTGTCGGTGATTGAGATGATCTCGAGATCATCTCAATCACCGACAGG | 2845 | chrX | ENST00000376327.5 |
| PLP2 | AATTCAAAAACGAAAGGGAATCCTCCTGTTTCTCGAGAAACAGGAGGATTCCCTTTCG | 2846 | chrX | ENST00000376327.5 |
| PPBP | AATTCAAAAAGGTGATGAATCTGCTGATTACTCGAGTAATCAGCAGATTCATCACCT | 2847 | chr4 | ENST00000296028.3 |
| PPBP | AATTCAAAAATGTTTCTGCCAAACTTCTTTACTCGAGTAAAGAAGTTTGGCAGAAACA | 2848 | chr4 | ENST00000296028.3 |
| PPBP | AATTCAAAAACTCCCAGGAAGGGTAGAATTTCTCGAGAAATTCTACCCTTCCTGGGAG | 2849 | chr4 | ENST00000296028.3 |
| PXDN | AATTCAAAAAGATTGCGACTGGACTCAAACCTCGAGGTTTGAGTCCAGTCGCAATCT | 2850 | chr2 | ENST00000252804.8 |
| PXDN | AATTCAAAAAGTTCCTGACGTCAGTCGAAATCTCGAGATTTCGACTGACGTCAGGAAC | 2851 | chr2 | ENST00000252804.8 |
| PXDN | AATTCAAAAAGAAGGATTCTTGACCATCAATCTCGAGATTGATGGTCAAGAATCCTTC | 2852 | chr2 | ENST00000252804.8 |
| RORC | AATTCAAAAACACCTCACAAATTGAAGTGATCTCGAGATCACTTCAATTTGTGAGGTG | 2853 | chr1 | ENST00000318247.6 |
| RORC | AATTCAAAAAGCCCTCATATTCCAACAACTTCTCGAGAAGTTGTTGGAATATGAGGGC | 2854 | chr1 | ENST00000318247.6 |
| RORC | AATTCAAAAAGCTTCTCAAAGCAGGAGCAATCTCGAGATTGCTCCTGCTTTGAGAAGC | 2855 | chr1 | ENST00000318247.6 |
| RORC | AATTCAAAAACGAGGATGAGATTGCCCTCTACTCGAGTAGAGGGCAATCTCATCCTCG | 2856 | chr1 | ENST00000318247.6 |
| SCG2 | AATTCAAAAACGACAAGGATCAAGAATTAGCTCGAGCTAATTCTTGATCCTTGTCGT | 2857 | chr2 | ENST00000305409.2 |
| SCG2 | AATTCAAAAACCTGTCTCTTATCCCTTTAATCTCGAGATTAAAGGGATAAGAGACAGG | 2858 | chr2 | ENST00000305409.2 |
| SCG2 | AATTCAAAAAGAAAGCAGCCCAGATTATAATCTCGAGATTATAATCTGGGCTGCTTTC | 2859 | chr2 | ENST00000305409.2 |
| SCGB3A1 | AATTCAAAAATCATAGAGGGCTCCCAGAAGTCTCGAGACTTCTGGGAGCCCTCTATGA | 2860 | chr5 | ENST00000292641.3 |
| SCGB3A1 | AATTCAAAAACCCGTGAACCACCTCATAGAGCTCGAGCTCTATGAGGTGGTTCACGGG | 2861 | chr5 | ENST00000292641.3 |
| SCGB3A1 | AATTCAAAAAGACTGGAGCATCTACACCTGACTCGAGTCAGGTGTAGATGCTCCAGTC | 2862 | chr5 | ENST00000292641.3 |
| SECTM1 | AATTCAAAAACACCAGAGAAATAACAGACAACTCGAGTTGTCTGTTATTTCTCTGGTG | 2863 | chr17 | ENST00000269389.7 |
| SECTM1 | AATTCAAAAACCATGACTCGAATATCTGAAACTCGAGTTTCAGATATTCGAGTCATGG | 2864 | chr17 | ENST00000269389.7 |
| SECTM1 | AATTCAAAAACCATGACTCGAATATCTGAAACTCGAGTTTCAGATATTCGAGTCATGG | 2865 | chr17 | ENST00000269389.7 |
| SLURP1 | AATTCAAAAAGTGCTTCCTGCAGGACCATTACTCGAGTAATGGTCCTGCAGGAAGCAC | 2866 | chr8 | ENST00000246515.1 |
| SLURP1 | AATTCAAAAAAGACCTCTGCAACTCGGAACTCTCGAGAGTTCCGAGTTGCAGAGGTCT | 2867 | chr8 | ENST00000246515.1 |
| SLURP1 | AATTCAAAAACTCAAGTGCTACACCTGCAAGCTCGAGCTTGCAGGTGTAGCACTTGAG | 2868 | chr8 | ENST00000246515.1 |
| SOSTDC1 | AATTCAAAAAGATGCCACAGAAATCCTTTATCTCGAGATAAAGGATTTCTGTGGCATC | 2869 | chr7 | ENST00000307068.4 |
| SOSTDC1 | AATTCAAAAAGGAACTGCGTTCCACCAAATACTCGAGTATTTGGTGGAACGCAGTTCC | 2870 | chr7 | ENST00000307068.4 |
| SOSTDC1 | AATTCAAAAATGAATCTTCACAGTAACATTTCTCGAGAAATGTTACTGTGAAGATTCA | 2871 | chr7 | ENST00000307068.4 |
| SP100 | AATTCAAAAAGAAGTGAGCCTGTGATCAATACTCGAGTATTGATCACAGGCTCACTTC | 2872 | chr2 | ENST00000340126.8 |
| SP100 | AATTCAAAAATATACGCTGCGGTGGATATACCTCGAGGTATATCCACCGCAGCGTATA | 2873 | chr2 | ENST00000340126.8 |
| SP100 | AATTCAAAAATCGTGATCTCATCACAAATAACTCGAGTTATTTGTGATGAGATCACGA | 2874 | chr2 | ENST00000340126.8 |
| SPI1 | AATTCAAAAAGCCCTATGACACGGATCTATACTCGAGTATAGATCCGTGTCATAGGGC | 2875 | chr11 | ENST00000378538.7 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| SPI1 | AATTCAAAAAGAGCTTCGCCGAGAACAACTCTCGAGAGTTGTTCTCGGCGAAGCTCT | 2876 | chr11 | ENST00000378538.7 |
| SPI1 | AATTCAAAAACGGATCTATACCAACGCCAAACTCGAGTTTGGCGTTGGTATAGATCCG | 2877 | chr11 | ENST00000378538.7 |
| SPI1 | AATTCAAAAACCGTATGTAAATCAGATCTCCCTCGAGGGAGATCTGATTTACATACGG | 2878 | chr11 | ENST00000378538.7 |
| SPP1 | AATTCAAAAACCACAAGCAGTCCAGATTATACTCGAGTATAATCTGGACTGCTTGTGG | 2879 | chr4 | ENST00000237623.11 |
| SPP1 | AATTCAAAAACCGAGGTGATAGTGTGGTTTACTCGAGTAAACCACACTATCACCTCGG | 2880 | chr4 | ENST00000237623.11 |
| SPP1 | AATTCAAAAACTTCAGGGTTATGTCTATGTTCTCGAGAACATAGACATAACCCTGAAG | 2881 | chr4 | ENST00000237623.11 |
| TBX21 | AATTCAAAAAGCCCTAACTACAGTCGTTTACCTCGAGGTAAACGACTGTAGTTAGGGC | 2882 | ch17 | ENST00000177694.1 |
| TBX21 | AATTCAAAAACCTGTTGTGGTCCAAGTTTAACTCGAGTTAAACTTGGACCACAACAGG | 2883 | ch17 | ENST00000177694.1 |
| TBX21 | AATTCAAAAACGCTTCCAACACGCATATCTTCTCGAGAAGATATGCGTGTTGGAAGCG | 2884 | ch17 | ENST00000177694.1 |
| TBX21 | AATTCAAAAACAATGTGACCCAGATGATTGCTCGAGCAATCATCTGGGTCACATTGT | 2885 | ch17 | ENST00000177694.1 |
| TCAP | AATTCAAAAACTTTGTAGTTTGCCCAGAGTTCTCGAGAACTCTGGGCAAACTACAAAG | 2886 | chr17 | ENST00000309889.2 |
| TCAP | AATTCAAAAAGGCCATGGCTGCTTTGTAGTTCTCGAGAACTACAAAGCAGCCATGGCC | 2887 | chr17 | ENST00000309889.2 |
| TCAP | AATTCAAAAAGGTGGCTGAGATCACAAAGCACTCGAGTGCTTTGTGATCTCAGCCACC | 2888 | chr17 | ENST00000309889.2 |
| TGFB1 | AATTCAAAAAACTGCGGATCTCTGTGTCATTCTCGAGAATGACACAGAGATCCGCAGT | 2889 | chr19 | ENST00000221930.5 |
| TGFB1 | AATTCAAAAACCACAACGAAATCTATGACAACTCGAGTTGTCATAGATTTCGTTGTGG | 2890 | chr19 | ENST00000221930.5 |
| TGFB1 | AATTCAAAAACCACAACGAAATCTATGACAACTCGAGTTGTCATAGATTTCGTTGTGG | 2891 | chr19 | ENST00000221930.5 |
| TGFB2 | AATTCAAAAAGCGGCCTATTGCTTTAGAAATCTCGAGATTTCTAAAGCAATAGGCCGC | 2892 | chr1 | ENST00000366930.8 |
| TGFB2 | AATTCAAAAAGCTGGAGCATGCCCGTATTTACTCGAGTAAATACGGGCATGCTCCAGC | 2893 | chr1 | ENST00000366930.8 |
| TGFB2 | AATTCAAAAATTGCTGCCTACGTCCACTTTACTCGAGTAAAGTGGACGTAGGCAGCAA | 2894 | chr1 | ENST00000366930.8 |
| TGFB3 | AATTCAAAAACATTGCCAAACAGCGCTATATCTCGAGATATAGCGCTGTTTGGCAATG | 2895 | chr14 | ENST00000238682.7 |
| TGFB3 | AATTCAAAAAGCTCTAGGGAATCTGGATTATCTCGAGATAATCCAGATTCCCTAGAGC | 2896 | chr14 | ENST00000238682.7 |
| TGFB3 | AATTCAAAAACGGAATACTATGCCAAAGAAACTCGAGTTTCTTTGGCATAGTATTCCG | 2897 | chr14 | ENST00000238682.7 |
| TGFBR1 | AATTCAAAAAGCCTTGAGAGTAATGGCTAAACTCGAGTTTAGCCATTACTCTCAAGGC | 2898 | chr9 | ENST00000374994.8 |
| TGFBR1 | AATTCAAAAACTCATGTTGATGGTCTATATCCTCGAGGATATAGACCATCAACATGAG | 2899 | chr9 | ENST00000374994.8 |
| TGFBR1 | AATTCAAAAAGAAGTTGCTGTTAAGATATTCCTCGAGGAATATCTTAACAGCAACTTC | 2900 | chr9 | ENST00000374994.8 |
| TGFBR2 | AATTCAAAAACGTTCAGAAGTCGGTTAATAACTCGAGTTATTAACCGACTTCTGAACG | 2901 | chr3 | ENST00000295754.9 |
| TGFBR2 | AATTCAAAAACTCTAGGCTTTATCGTGTTTACTCGAGTAAACACGATAAAGCCTAGAG | 2902 | chr3 | ENST00000295754.9 |
| TGFBR2 | AATTCAAAAACTCAGGAAATGAGATTGATTTCTCGAGAAATCAATCTCATTTCCTGAG | 2903 | chr3 | ENST00000295754.9 |
| TGFBR3 | AATTCAAAAAGGAGTTGGTAAAGGGTTAATACTCGAGTATTAACCCTTTACCAACTCC | 2904 | chr1 | ENST00000212355.8 |
| TGFBR3 | AATTCAAAAATAATGGATTTCCGGGAGATATCTCGAGATATCTCCCGGAAATCCATTA | 2905 | chr1 | ENST00000212355.8 |
| TGFBR3 | AATTCAAAAACACACCCAGGGCTAGTATAAACTCGAGTTTATACTAGCCCTGGGTGTG | 2906 | chr1 | ENST00000212355.8 |
| THBS1 | AATTCAAAAAGTAGGTTATGATGAGTTTAATCTCGAGATTAAACTCATCATAACCTAC | 2907 | chr15 | ENST00000260356.5 |
| THBS1 | AATTCAAAAACGTGACTGTAAGATTGTAAATCTCGAGATTTACAATCTTACAGTCACG | 2908 | chr15 | ENST00000260356.5 |
| THBS1 | AATTCAAAAAGAGATCCCTAATCATCAAATTCTCGAGAATTTGATGATTAGGGATCTC | 2909 | chr15 | ENST00000260356.5 |
| THNSL2 | AATTCAAAAAGAGCCGATCAAGACTGTGTTTCTCGAGAAACACAGTCTTGATCGGCTC | 2910 | chr2 | ENST00000324166.6 |
| THNSL2 | AATTCAAAAAGCTGCCATTGAGAGTGTTCAACTCGAGTTGAACACTCTCAATGGCAGC | 2911 | chr2 | ENST00000324166.6 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| THNSL2 | AATTCAAAAAGCTGCCATTGAGAGTGTTCAACTCGAGTTGAACACTCTCAATGGCAGC | 2912 | chr2 | ENST00000324166.6 |
| THPO | AATTCAAAAAGACCTCCGAGTCCTCAGTAAACTCGAGTTTACTGAGGACTCGGAGGTC | 2913 | chr3 | ENST00000204615.11 |
| THPO | AATTCAAAAAGCTAGCTCTTTGGTCTATTTCTCGAGAAATAGACCAAAGAGCTAGCT | 2914 | chr3 | ENST00000204615.11 |
| THPO | AATTCAAAAACAACCTCCAGCCTGGATATTCCTCGAGGAATATCCAGGCTGGAGGTTG | 2915 | chr3 | ENST00000204615.11 |
| TIMP1 | AATTCAAAAAGCACAGTGTTTCCCTGTTTATCTCGAGATAAACAGGGAAACACTGTGC | 2916 | chrX | ENST00000218388.8 |
| TIMP1 | AATTCAAAAAGCACAGTGTTTCCCTGTTTATCTCGAGATAAACAGGGAAACACTGTGC | 2917 | chrX | ENST00000218388.8 |
| TIMP1 | AATTCAAAAACAGACGGCCTTCTGCAATTCCTCGAGGAATTGCAGAAGGCCGTCTGT | 2918 | chrX | ENST00000218388.8 |
| TNF | AATTCAAAAAGAACCCAAGCTTAGAACTTTACTCGAGTAAAGTTCTAAGCTTGGGTTC | 2919 | chr6 | ENST00000449264.2 |
| TNF | AATTCAAAAAGGAGCCAGCTCCCTCTATTTACTCGAGTAAATAGGGGAGCTGGCTCC | 2920 | chr6 | ENST00000449264.2 |
| TNF | AATTCAAAAATGGCGTGGAGCTGAGAGATAACTCGAGTTATCTCTCAGCTCCACGCCA | 2921 | chr6 | ENST00000449264.2 |
| TNFRSF4 | AATTCAAAAAGCACGTGGTGTAACCTCAGAACTCGAGTTCTGAGGTTACACCACGTGC | 2922 | chr1 | ENST00000379236.3 |
| TNFRSF4 | AATTCAAAAACAGCAATAGCTCGGACGCAATCTCGAGATTGCGTCCGAGCTATTGCTG | 2923 | chr1 | ENST00000379236.3 |
| TNFRSF4 | AATTCAAAAAGACAGCTACAAGCCTGGAGTTCTCGAGAACTCCAGGCTTGTAGCTGTC | 2924 | chr1 | ENST00000379236.3 |
| TNFRSF4 | AATTCAAAAAGCTTCTACAACGACGTGGTCACTCGAGTGACCACGTCGTTGTAGAAGC | 2925 | chr1 | ENST00000379236.3 |
| TNFRSF11 | AATTCAAAAATGTTTACTTGCCCGGTTTAATCTCGAGATTAAACCGGGCAAGTAAACA | 2926 | chr18 | ENST00000586569.2 |
| TNFRSF11 | AATTCAAAAATGTACCAGTGAGAAGCATTATCTCGAGATAATGCTTCTCACTGGTACA | 2927 | chr18 | ENST00000586569.2 |
| TNFRSF11 | AATTCAAAAATGGGACGGTGCTGTAACAAATCTCGAGATTTGTTACAGCACCGTCCCA | 2928 | chr18 | ENST00000586569.2 |
| TNFRSF11 | AATTCAAAAAGAAAGCACTCACAGCTAATTTCTCGAGAAATTAGCTGTGAGTGCTTTC | 2929 | chr8 | ENST00000297350.8 |
| TNFRSF11 | AATTCAAAAAGATAAATGCTTGCTGCATAAACTCGAGTTTATGCAGCAAGCATTTATC | 2930 | chr8 | ENST00000297350.8 |
| TNFRSF11 | AATTCAAAAACCAGTGTGTGTTCATTGTAAACTCGAGTTTACAATGAACACACACTGG | 2931 | chr8 | ENST00000297350.8 |
| TNFRSF1A | AATTCAAAAAAGAACCAGTACCGGCATTATTCTCGAGAATAATGCCGGTACTGGTTCT | 2932 | chr12 | ENST00000162749.6 |
| TNFRSF1A | AATTCAAAAAGGAGCTGTTGGTGGGAATATACTCGAGTATATTCCCACCAACAGCTCC | 2933 | chr12 | ENST00000162749.6 |
| TNFRSF1A | AATTCAAAAACTTGAAGGAACTACTACTAAGCTCGAGCTTAGTAGTAGTTCCTTCAAG | 2934 | chr12 | ENST00000162749.6 |
| TNFRSF9 | AATTCAAAAAGCTCCGTTTCTCTGTTGTTAACTCGAGTTAACAACAGAGAAACGGAGC | 2935 | chr1 | ENST00000377507.7 |
| TNFRSF9 | AATTCAAAAACAAGAACACCATCCTACATAACTCGAGTTATGTAGGATGGTGTTCTTG | 2936 | chr1 | ENST00000377507.7 |
| TNFRSF9 | AATTCAAAAACAGTCCCTGTCCTCCAAATAGCTCGAGCTATTTGGAGGACAGGGACTG | 2937 | chr1 | ENST00000377507.7 |
| TNFSF9 | AATTCAAAAACAAGTTGGACCTGATATTTACTCGAGTAAATATCAAGGTCCAACTTG | 2938 | chr19 | ENST00000245817.4 |
| TNFSF9 | AATTCAAAAACTACTATGTCTTCTTTCAACTCTCGAGAGTTGAAAGAAGACATAGTAG | 2939 | chr19 | ENST00000245817.4 |
| TNFSF9 | AATTCAAAAACCCTTCACCGAGGTCGGAATACTCGAGTATTCCGACCTCGGTGAAGGG | 2940 | chr19 | ENST00000245817.4 |
| TNFSF9 | AATTCAAAAATGAGCTACAAAGAGGACACGACTCGAGTCGTGTCCTCTTTGTAGCTCA | 2941 | chr19 | ENST00000245817.4 |
| TNFSF10 | AATTCAAAAAAGAAATAGTTGTTGGTCTAAACTCGAGTTTAGACCAACAACTATTTCT | 2942 | chr3 | ENST00000241261.6 |
| TNFSF10 | AATTCAAAAAGTTATCCTGACCCTATATTGCTCGAGCAATATAGGGTCAGGATAACT | 2943 | chr3 | ENST00000241261.6 |
| TNFSF10 | AATTCAAAAAGACAAACAAATGGTCCAATATCTCGAGATATTGGACCATTTGTTTGTC | 2944 | chr3 | ENST00000241261.6 |
| TNFSF11 | AATTCAAAAACTAATGGTGTACGTCACTAAACTCGAGTTTAGTGACGTACACCATTAG | 2945 | chr13 | ENST00000398795.6 |
| TNFSF11 | AATTCAAAAACCGGATCAGGATGCAACATACCTCGAGGTATGTTGCATCCTGATCCGG | 2946 | chr13 | ENST00000398795.6 |
| TNFSF11 | AATTCAAAAAGCAGTATATTTCTTCGTTCTTCTCGAGAAGAACGAAGAAATATACTGC | 2947 | chr13 | ENST00000398795.6 |
| TNFSF12 | AATTCAAAAAGTATTCCCACTCTTATCTTACCTCGAGGTAAGATAAGAGTGGGAATAC | 2948 | chr17 | ENST00000293825.10 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
| --- | --- | --- | --- | --- |
| TNFSF12 | AATTCAAAAAGGGCATTGTGTTCACTGTACTCTCGAGAGTACAGTGAACACAATGCCC | 2949 | chr17 | ENST00000293825.10 |
| TNFSF12 | AATTCAAAAACAGATGGAGGTTACACAACTTCTCGAGAAGTTGTGTAACCTCCATCTG | 2950 | chr17 | ENST00000293825.10 |
| TNFSF12- | AATTCAAAAACCTCACCTACTTCGGACTCTTCTCGAGAAGAGTCCGAAGTAGGTGAGG | 2951 | chr17 | ENST00000293826.4 |
| TNFSF12- | AATTCAAAAACTGTACTGTCAGGTGCACTTTCTCGAGAAAGTGCACCTGACAGTACAG | 2952 | chr17 | ENST00000293826.4 |
| TNFSF12- | AATTCAAAAAGCGCAGGCAGATGGAGGTTACCTCGAGGTAACCTCCATCTGCCTGCGC | 2953 | chr17 | ENST00000293826.4 |
| TNFSF13 | AATTCAAAAACAGTTGCCCTCTGGTTGAGTTCTCGAGAACTCAACCAGAGGGCAACTG | 2954 | chr17 | ENST00000338784.8 |
| TNFSF13 | AATTCAAAAAATGGCTCTGCTGACCCAACAACTCGAGTTGTTGGGTCAGCAGAGCCAT | 2955 | chr17 | ENST00000338784.8 |
| TNFSF13 | AATTCAAAAACCCAACAAACAGAGCTGCAGACTCGAGTCTGCAGCTCTGTTTGTTGGG | 2956 | chr17 | ENST00000338784.8 |
| TNFSF13B | AATTCAAAAACCTGAAACACTACCCAATAATCTCGAGATTATTGGGTAGTGTTTCAGG | 2957 | chr13 | ENST00000375887.8 |
| TNFSF13B | AATTCAAAAACTACGCCATGGGACATCTAATCTCGAGATTAGATGTCCCATGGCGTAG | 2958 | chr13 | ENST00000375887.8 |
| TNFSF13B | AATTCAAAAAGTGACTTTGTTTCGATGTATTCTCGAGAATACATCGAAACAAAGTCAC | 2959 | chr13 | ENST00000375887.8 |
| TNFSF14 | AATTCAAAAATCCTGGGAGCAGCTGATACAACTCGAGTTGTATCAGCTGCTCCCAGGA | 2960 | chr19 | ENST00000599359.1 |
| TNFSF14 | AATTCAAAAAGACAGACCGACATCCCATTCACTCGAGTGAATGGGATGTCGGTCTGTC | 2961 | chr19 | ENST00000599359.1 |
| TNFSF14 | AATTCAAAAAATGGGTCTGACACGTGGAGAACTCGAGTTCTCCACGTGTCAGACCCAT | 2962 | chr19 | ENST00000599359.1 |
| TNFSF15 | AATTCAAAAAATTAAGACACTGATCACTAAACTCGAGTTTAGTGATCAGTGTCTTAAT | 2963 | chr9 | ENST00000374045.4 |
| TNFSF15 | AATTCAAAAAGTCGGAGACTACTTCATTTACTCGAGTAAATGAAGTAGTCTCCCGAC | 2964 | chr9 | ENST00000374045.4 |
| TNFSF15 | AATTCAAAAAACTATAGGAGGAGAGCAAATACTCGAGTATTTGCTCTCCTCCTATAGT | 2965 | chr9 | ENST00000374045.4 |
| TNFSF18 | AATTCAAAAACCTTCAGTTGGCTAATCTTTACTCGAGTAAAGATTAGCCAACTGAAGG | 2966 | chr1 | ENST00000404377.3 |
| TNFSF18 | AATTCAAAAACTGAACCTCCTTGCGTGAATACTCGAGTATTCACGCAAGGAGGTTCAG | 2967 | chr1 | ENST00000404377.3 |
| TNFSF18 | AATTCAAAAATGATACAAACTCTAACAAACCTCGAGGTTTGTTAGAGTTTGTATCAT | 2968 | chr1 | ENST00000404377.3 |
| TNFSF4 | AATTCAAAAAGTGGCCTCTCTGACTTACAAACTCGAGTTTGTAAGTCAGAGAGGCCAC | 2969 | chr1 | ENST00000281834.3 |
| TNFSF4 | AATTCAAAAAGCAGAACAACTCAGTCATCATCTCGAGATGATGACTGAGTTGTTCTGC | 2970 | chr1 | ENST00000281834.3 |
| TNFSF4 | AATTCAAAAAGCCAAGATTCGAGAGGAACAACTCGAGTTGTTCCTCTCGAATCTTGGC | 2971 | chr1 | ENST00000281834.3 |
| TNFSF8 | AATTCAAAAACTGTATGGTCTTGATCTATTCTCGAGAATAGATCAAGACCATACAGT | 2972 | chr9 | ENST00000223795.2 |
| TNFSF8 | AATTCAAAAACAAACTACACAGGGTATTAAACTCGAGTTTAATACCCTGTGTAGTTTG | 2973 | chr9 | ENST00000223795.2 |
| TNFSF8 | AATTCAAAAAGTGGATACATTCCAGTACATACTCGAGTATGTACTGGAATGTATCCAC | 2974 | chr9 | ENST00000223795.2 |
| TNFSF9 | AATTCAAAAACAAGTTGGACCTTGATATTTACTCGAGTAAATATCAAGGTCCAACTTG | 2975 | chr19 | ENST00000245817.4 |
| TNFSF9 | AATTCAAAAACTACTATGTCTTCTTTCAACTCTCGAGAGTTGAAAGAAGACATAGTAG | 2976 | chr19 | ENST00000245817.4 |
| TNFSF9 | AATTCAAAAACCCTTCACCGAGGTCGGAATACTCGAGTATTCCGACCTCGGTGAAGGG | 2977 | chr19 | ENST00000245817.4 |
| TRIM16 | AATTCAAAAAGCCGTTGTTCAGCGCAAATATCTCGAGATATTTGCGCTGAACAACGGC | 2978 | chr17 | ENST00000336708.11 |
| TRIM16 | AATTCAAAAAGCCGTTGTTCAGCGCAAATATCTCGAGATATTTGCGCTGAACAACGGC | 2979 | chr17 | ENST00000336708.11 |
| TRIM16 | AATTCAAAAACCGCATCAGGTGAACATCAAACTCGAGTTTGATGTTCACCTGATGCGG | 2980 | chr17 | ENST00000336708.11 |
| TSLP | AATTCAAAAAACTCAATGATAGCACCTAAACCTCGAGGTTTAGGTGCTATCATTGAGT | 2981 | chr5 | ENST00000344895.3 |
| TSLP | AATTCAAAAACGTCGCTTCAATCGACCTTTACTCGAGTAAAGGTCGATTGAAGCGACG | 2982 | chr5 | ENST00000344895.3 |
| TSLP | AATTCAAAAACCATCTTTATTATGGTCATATCTCGAGATATGACCATAATAAAGATGG | 2983 | chr5 | ENST00000344895.3 |
| TWSG1 | AATTCAAAAAGACTGTGTTGGTATGTGTAATCTCGAGATTACACATACCAACACAGTC | 2984 | chr18 | ENST00000262120.9 |

TABLE 16-continued

3' to 5' (Reverse) shRNA sequences for Silencing of Cytokine/Chemokine Genes to Reduce the Incidence of CRS

| Target Gene Symbol | shRNA Reverse Oligo Sequence | SEQ ID NO: | Location | Gene ID No. |
|---|---|---|---|---|
| TWSG1 | AATTCAAAAAGCGCCTTATTCCAGTGACAAACTCGAGTTTGTCACTGGAATAAGGCGC | 2985 | chr18 | ENST00000262120.9 |
| TWSG1 | AATTCAAAAAGAATCACTGAGCTGTAACAAACTCGAGTTTGTTACAGCTCAGTGATTC | 2986 | chr18 | ENST00000262120.9 |
| TXLNA | AATTCAAAAAGCACATACTGTGTGGACAATACTCGAGTATTGTCCACACAGTATGTGC | 2987 | chr1 | ENST00000373609.1 |
| TXLNA | AATTCAAAAATGCTGATGCAGACATTGAATACTCGAGTATTCAATGTCTGCATCAGCA | 2988 | chr1 | ENST00000373609.1 |
| TXLNA | AATTCAAAAAGCGAGGTATTCACCACATTCCTCGAGGAATGTGGTGAATACCTCGCT | 2989 | chr1 | ENST00000373609.1 |
| VASN | AATTCAAAAAGCTTGACTACGCCGACTTTGCTCGAGCAAAGTCGGCGTAGTCAAGCT | 2990 | chr16 | ENST00000304735.3 |
| VASN | AATTCAAAAAGCCAACAGGCTGCATGAAATCTCGAGATTTCATGCAGCCTGTTGGCT | 2991 | chr16 | ENST00000304735.3 |
| VASN | AATTCAAAAAGAGATCCTTTCCCATTTATTCCTCGAGGAATAAATGGGAAAGGATCTC | 2992 | chr16 | ENST00000304735.3 |
| VEGFA | AATTCAAAAACAAGATCCGCAGACGTGTAAACTCGAGTTTACACGTCTGCGGATCTTG | 2993 | chr6 | ENST00000425836.6 |
| VEGFA | AATTCAAAAACAAGATCCGCAGACGTGTAAACTCGAGTTTACACGTCTGCGGATCTTG | 2994 | chr6 | ENST00000425836.6 |
| VEGFA | AATTCAAAAAGCGCAAGAAATCCCGGTATAACTCGAGTTATACCGGGATTTCTTGCGC | 2995 | chr6 | ENST00000425836.6 |
| VSTM1 | AATTCAAAAAATGAATATGCGGCACTGAAAGCTCGAGCTTTCAGTGCCGCATATTCAT | 2996 | chr19 | ENST00000338372.6 |
| VSTM1 | AATTCAAAAACATTCCCAGAATGTGACATTTCTCGAGAAATGTCACATTCTGGGAATG | 2997 | chr19 | ENST00000338372.6 |
| VSTM1 | AATTCAAAAAGAGTGACCTATGCTGAGCTAACTCGAGTTAGCTCAGCATAGGTCACTC | 2998 | chr19 | ENST00000338372.6 |
| WFIKKN1 | AATTCAAAAATGCGCCCTGATCAGATGTATGCTCGAGCATACATCTGATCAGGGCGCA | 2999 | chr16 | ENST00000319070.2 |
| WFIKKN1 | AATTCAAAAAGGACGTGCTCAAGGATGACAACTCGAGTTGTCATCCTTGAGCACGTCC | 3000 | chr16 | ENST00000319070.2 |
| WFIKKN1 | AATTCAAAAAGTGCTGCATCAACGTGTGCTCGAGCACACACGTTGATGCAGCACT | 3001 | chr16 | ENST00000319070.2 |
| WFIKKN2 | AATTCAAAAATCAAGTTCTTGGGCACCAAGTCTCGAGACTTGGTGCCCAAGAACTTGA | 3002 | chr17 | ENST00000311378.4 |
| WFIKKN2 | AATTCAAAAATACAACCGCTGCTATATGGACCTCGAGGTCCATATAGCAGCGGTTGTA | 3003 | chr17 | ENST00000311378.4 |
| WFIKKN2 | AATTCAAAAACACCAGCTTGCTCAGATATTCCTCGAGGAATATCTGAGCAAGCTGGTG | 3004 | chr17 | ENST00000311378.4 |
| WNT1 | AATTCAAAAACTGTCGAGAAACGGCGTTTATCTCGAGATAAACGCCGTTTCTCGACAG | 3005 | chr12 | ENST00000293549.3 |
| WNT1 | AATTCAAAAAGACCTCGTCTACTTCGAGAAACTCGAGTTTCTCGAAGTAGACGAGGTC | 3006 | chr12 | ENST00000293549.3 |
| WNT1 | AATTCAAAAAGCCACGAGTTTGGATGTTGTACTCGAGTACAACATCCAAACTCGTGGC | 3007 | chr12 | ENST00000293549.3 |
| WNT2 | AATTCAAAAACCACAAATGGTCCCAATTAAGCTCGAGCTTAATTGGGACCATTTGTGG | 3008 | chr7 | ENST00000265441.7 |
| WNT2 | AATTCAAAAATCGGGAATCTGCCTTTGTTTACTCGAGTAAACAAAGGCAGATTCCCGA | 3009 | chr7 | ENST00000265441.7 |
| WNT2 | AATTCAAAAATTGACTATGGGATCAAATTTGCTCGAGCAAATTTGATCCCATAGTCAA | 3010 | chr7 | ENST00000265441.7 |
| WNT5A | AATTCAAAAACTCCCAGGACCCGCTTATTTACTCGAGTAAATAAGCGGGTCCTGGGAG | 3011 | chr3 | ENST00000264634.8 |
| WNT5A | AATTCAAAAACAAAGAATGCCAGTATCAATTCTCGAGAATTGATACTGGCATTCTTTG | 3012 | chr3 | ENST00000264634.8 |
| WNT5A | AATTCAAAAACCTGTTCAGATGTCAGAAGTACTCGAGTACTTCTGACATCTGAACAGG | 3013 | chr3 | ENST00000264634.8 |
| WNT7A | AATTCAAAAACATAGGAGAAGGCTCACAAATCTCGAGATTTGTGAGCCTTCTCCTATG | 3014 | chr3 | ENST00000285018.4 |
| WNT7A | AATTCAAAAAGGCGCAAGCATCATCTGTAACCTCGAGGTTACAGATGATGCTTGCGCC | 3015 | chr3 | ENST00000285018.4 |
| WNT7A | AATTCAAAAATCTTCGGGAAGGAGCTCAAAGCTCGAGCTTTGAGCTCCTTCCCGAAGA | 3016 | chr3 | ENST00000285018.4 |
| XCL1 | AATTCAAAAAGCTGTGCAATGGCAACAATTCTCGAGAATTGTTGCCATTGTCACAGC | 3017 | chr1 | ENST00000367818.3 |
| XCL1 | AATTCAAAAATTCAACTTGTCTCTATAATAGCTCGAGCTATTATAGAGACAAGTTGAA | 3018 | chr1 | ENST00000367818.3 |
| XCL1 | AATTCAAAAAGATTCTGGCTAGTGTCTATCCTCGAGGATAGACACTAGCCAGAATCT | 3019 | chr1 | ENST00000367818.3 |
| XCL2 | AATTCAAAAAACTGCCAGTTAGCAGAATCAACTCGAGTTGATTCTGCTAACTGGCAGT | 3020 | chr1 | ENST00000367819.2 |
| XCL2 | AATTCAAAAAGTAGGGAGTGAAGTCTCACATCTCGAGATGTGAGACTTCACTCCCTAC | 3021 | chr1 | ENST00000367819.2 |

TABLE 16-continued

3' to 5' (Reverse) shRNA sequences for Silencing of Cytokine/Chemokine
Genes to Reduce the Incidence of CRS

| Target Gene Symbol | shRNA Reverse Oligo Sequence | SEQ ID NO: | Location | Gene ID No. |
|---|---|---|---|---|
| XCL2 | AATTCAAAAAGAAATCCAACACCAGAAATAACTCGAGTTATTTCTGGTGTTGGATTTC | 3022 | chr1 | ENST00000367819.2 |
| ZFP36 | AATTCAAAAAGATCCGACCCTGATGAATATGCTCGAGCATATTCATCAGGGTCGGATC | 3023 | chr19 | ENST00000597629.1 |
| ZFP36 | AATTCAAAAAATCTGTCTCCTAGAATCTTATCTCGAGATAAGATTCTAGGAGACAGAT | 3024 | chr19 | ENST00000597629.1 |
| ZFP36 | AATTCAAAAACCCTTTATTTATGACGACTTTCTCGAGAAAGTCGTCATAAATAAAGGG | 3025 | chr19 | ENST00000597629.1 |

Example 16—Method of Making and Testing Cells Deficient in Specific Cytokine Expression Using Protein Expression Blockers (PEBL)—CAR19-GM-CSF PEBL Inject tumor in SCID-Beige mice (3e6 Raji containing Luciferase) if performing in vivo CRS experiment. This should be completed 3 weeks prior to infusion of CAR-T into mice.

The following sERteps may be taken to provide CRS resistance. A selectable marker is required to enrich for this gene modification as cytokines are secreted proteins, thus. This example describes the making of a cell CAR19-GM-CSF PEBL, in which blockade of GM-CSF secretion mitigates risk of CRS. As those of skill in the art will recognize, certain of the steps may be conducted sequentially or out of the order listed below, though perhaps leading to different efficiency.

Step 1: T Cell Activation (Day 0)

Purify T cells from leukapheresis chamber using Miltenyi juman PanT isolation kit. Resuspend in media. Count cells. Determine number of human T cell activation CD3/CD28 beands required to obtain 3:1 bead: cell ratio. Wash beads 2× with T cell media. Dilute cells at 1.256 cells/mL in hXcyte media. Add human T cell activation CD3/CD28 beads. Aliquot 4 ml/well of 1.256 cells/mL solution into 6-well plate. Incubate at 37° C.

Step 2: Transduction of T Cells with PEBL CAR (Day 1)

T cells are transduced with a CAR targeted to (i.e., that recognizes) one or more antigen or protein targets, for example with a Lentivirus containing a CAR construct targeting CD19, combined with the anti-GM-CSF PEBL. Expression from a polycistronic vector is preferable, allowing CD34 expression to mark both CAR and PEBL expression. However, expression can be achieved with the same viral vector expressing both the CAR and PEBL individually, or as independent transductions with separate vectors containing CAR and PEBL. Any other suitable method of transduction may be used, for example, AAV, retrovirus, etc, or through direct insertion of the CAR PEBL complex into a targeted location of the genome using homology directed repair and a donor vector containing the construct.

Step 3: Assessment of Td Efficiency (Day 10)

Take $5\times10^5$ cells from each sample and analyze by flow cytometry. Wash samples with RB. Add 3 μL of anti-CD34 PE antibody. Add 5 μL of CD3 APC and 2 μL of anti-FAB BV421 (detects CAR transduction). Wash. Perform flow cytometry. Cells should be CD34-positive indicating expression of CAR and PEBL from a polycistronic vector. Harvest T cells (Day 11).

Purification of CAR-T cells. CAR+ (CD34+) and GC-CSF deficient (PEBL+) cells can be enriched using a CD34-positive selection on the Miltenyi Automacs. This enriches the GC-CSF suppressed cells and enriches CAR+ cells.

Step 4: Assessment of CAR-T Activity

Inject $3\times10^7$ CAR-T cells per mouse I.P. Assess serum cytokine levels. (Day 12, Day 13, Day 14). Measure serum cytokine levels using Luminex multiplex profiling assay to check for elevations in CRS-related cytokines. Perform a 4-hour chromium release assay against target cells (Raji) to assess in vitro activity (Day 11).

PEBL constructs targeting GM-CSF are provided in FIG. 6 and Tables 17 and 18.

TABLE 17

Anti-GM-CSF PEBL Constructs (SEQ ID NOS 3071-3076, respectively)

| CD28 Leader | $V_L$ | Linker | $V_H$ | ER-Retention Domain | 2a | trCD34 |
|---|---|---|---|---|---|---|
| MALPVTALLLP LALLLHAARP (SEQ ID NO: 1) | DIELTQPPSVS VAPGQTARISC SGDNLPGKYVH WYQQKPGQAPV LVIYYDSNRPS GIPERFSGSNS GNTATLTISGT QAEDEADYYCQ SRTQTTIVFGG GTKLTVLGQ (SEQ ID NO: 3026) | GGGGS(n)n = 1, 2, 3, 4 (SEQ ID NO: 3069) | QVQLVESGGG LVQPGGSLRL SCAASGFTFS SHWMSWVRQA PGKGLEWVSN IWRGPYIYYA DSVKGRFTIS RDNSKNTLYL QMNSLRAEDT AVYYCARFQG YGGGFDYWGQ GTLVTVSS (SEQ ID NO: 3027) | EQKLISEEDLKD EL (SEQ ID NO: 3028) | | |

TABLE 17-continued

Anti-GM-CSF PEBL Constructs (SEQ ID NOS 3071-3076, respectively)

| CD28 Leader | V_L | Linker | V_H | ER-Retention Domain | 2a | trCD34 |
|---|---|---|---|---|---|---|
| MALPVTALLLP LALLLHAARP (SEQ ID NO: 1) | DIELTQPPSVS VAPGQTARISC SGDNLPGKYVH WYQQKPGQAPV LVIYYDSNRPS GIPERFSGSNS GNTATLTISGT QAEDEADYYCQ SRTQTTIVFGG GTKLTVLGQ (SEQ ID NO: 3026) | GGGGS(n)n = 1, 2, 3, 4 (SEQ ID NO: 3069) | QVQLVESGGG LVQPGGSLRL SCAASGFTFS SHWMSWVRQA PGKGLEWVSN IWRGPYIYYA DSVKGRFTIS RDNSKNTLYL QMNSLRAEDT AVYYCARFQG YGGGFDYWGQ GTLVTVSS (SEQ ID NO: 3027) | (GGGGS)4AEK DEL (SEQ ID NO: 3029) | | |
| MALPVTALLLP LALLLHAARP (SEQ ID NO: 1) | DIELTQPPSVS VAPGQTARISC SGDNLPGKYVH WYQQKPGQAPV LVIYYDSNRPS GIPERFSGSNS GNTATLTISGT QAEDEADYYCQ SRTQTTIVFGG GTKLTVLGQ (SEQ ID NO: 3026) | GGGGS(n)n = 1, 2, 3, 4 (SEQ ID NO: 3069) | QVQLVESGGG LVQPGGSLRL SCAASGFTFS SHWMSWVRQA PGKGLEWVSN IWRGPYIYYA DSVKGRFTIS RDNSKNTLYL QMNSLRAEDT AVYYCARFQG YGGGFDYWGQ GTLVTVSS (SEQ ID NO: 3027) | TTTPAPRPPTPA PTIASQPLSLRP EACRPAAGGAVH TRGLDFACDIYI WAPLAGTCGVLL LSLVITLYCNHR NLYKYKSRRSFI DEKKMP (SEQ ID NO: 3030) | | |
| MALPVTALLLP LALLLHAARP (SEQ ID NO: 1) | DIELTQPPSVS VAPGQTARISC SGDNLPGKYVH WYQQKPGQAPV LVIYYDSNRPS GIPERFSGSNS GNTATLTISGT QAEDEADYYCQ SRTQTTIVFGG GTKLTVLGQ (SEQ ID NO: 3026) | GGGGS(n)n = 1, 2, 3, 4 (SEQ ID NO: 3069) | QVQLVESGGG LVQPGGSLRL SCAASGFTFS SHWMSWVRQA PGKGLEWVSN IWRGPYIYYA DSVKGRFTIS RDNSKNTLYL QMNSLRAEDT AVYYCARFQG YGGGFDYWGQ GTLVTVSS (SEQ ID NO: 3027) | EQKLISEEDLKD EL (SEQ ID NO: 3028) | GSGATNFSLLK QAGDVEENPGP (SEQ ID NO: 3031) | MPRGWTALCLL SLLPSGFMSLD NNGTATPELPT QGTFSNVSTNV SYQETTTPSTL GSTSLHPVSQH GNEATTNITET TVKFTSTSVIT SVYGNTNSSVQ SQTSVISTVFT TPANVSTPETT LKPSLSPGNVS DLSTTSTSLAT SPTKPYTSSSP ILSDIKAEIKC SGIREVKLTQG ICLEQNKTSSC AEFKKDRGEGL ARVLCGEEQAD ADAGAQVCSLL LAQSEVRPQCL LLVLANRTEIS SKLQLMKKHQS DLKKLGILDFT EQDVASHQSYS QKTLIALVTSG ALLAVLGITGY FLMNRRSWSPI (SEQ ID NO: 3032) |
| MALPVTALLLP LALLLHAARP (SEQ ID NO: 1) | DIELTQPPSVS VAPGQTARISC SGDNLPGKYVH WYQQKPGQAPV LVIYYDSNRPS GIPERFSGSNS GNTATLTISGT QAEDEADYYCQ | GGGGS(n)n = 1, 2, 3, 4 (SEQ ID NO: 3069) | QVQLVESGGG LVQPGGSLRL SCAASGFTFS SHWMSWVRQA PGKGLEWVSN IWRGPYIYYA DSVKGRFTIS RDNSKNTLYL | (GGGGS)4AEK DEL (SEQ ID NO: 3029) | GSGATNFSLLK QAGDVEENPGP (SEQ ID NO: 3031) | MPRGWTALCLL SLLPSGFMSLD NNGTATPELPT QGTFSNVSTNV SYQETTTPSTL GSTSLHPVSQH GNEATTNITET TVKFTSTSVIT |

TABLE 17-continued

Anti-GM-CSF PEBL Constructs (SEQ ID NOS 3071-3076, respectively)

| CD28 Leader | V_L | Linker | V_H | ER-Retention Domain | 2a | trCD34 |
|---|---|---|---|---|---|---|
| | SRTQTTIVFGG GTKLTVLGQ (SEQ ID NO: 3026) | | QMNSLRAEDT AVYYCARFQG YGGGFDYWGQ GTLVTVSS (SEQ ID NO: 3027) | | | SVYGNTNSSVQ SQTSVISTVFT TPANVSTPETT LKPSLSPGNVS DLSTTSTSLAT SPTKPYTSSSP ILSDIKAEIKC SGIREVKLTQG ICLEQNKTSSC AEFKKDRGEGL ARVLCGEEQAD ADAGAQVCSLL LAQSEVRPQCL LLVLANRTEIS SKLQLMKKHQS DLKKLGILDFT EQDVASHQSYS QKTLIALVTSG ALLAVLGITGY FLMNRRSWSPI (SEQ ID NO: 3032) |
| MALPVTALLLP LALLLHAARP (SEQ ID NO: 1) | DIELTQPPSVS VAPGQTARISC SGDNLPGKYVH WYQQKPGQAPV LVIYYDSNRPS GIPERFSGSNS GNTATLTISGT QAEDEADYYCQ SRTQTTIVFGG GTKLTVLGQ (SEQ ID NO: 3026) | GGGGS(n)n = 1, 2, 3, 4 (SEQ ID NO: 3069) | QVQLVESGGG LVQPGGSLRL SCAASGFTFS SHWMSWVRQA PGKGLEWVSN IWRGPYIYYA DSVKGRFTIS RDNSKNTLYL QMNSLRAEDT AVYYCARFQG YGGGFDYWGQ GTLVTVSS (SEQ ID NO: 3027) | TTTPAPRPPTPA PTIASQPLSLRP EACRPAAGGAVH TRGLDFACDIYI WAPLAGTCGVLL LSLVITLYCNHR NLYKYKSRRSFI DEKKMP (SEQ ID NO: 3030) | GSGATNFSLLK QAGDVEENPGP (SEQ ID NO: 3031) | MPRGWTALCLL SLLPSGFMSLD NNGTATPELPT QGTFSNVSTNV SYQETTTPSTL GSTSLHPVSQH GNEATTNITET TVKFTSTSVIT SVYGNTNSSVQ SQTSVISTVFT TPANVSTPETT LKPSLSPGNVS DLSTTSTSLAT SPTKPYTSSSP ILSDIKAEIKC SGIREVKLTQG ICLEQNKTSSC AEFKKDRGEGL ARVLCGEEQAD ADAGAQVCSLL LAQSEVRPQCL LLVLANRTEIS SKLQLMKKHQS DLKKLGILDFT EQDVASHQSYS QKTLIALVTSG ALLAVLGITGY FLMNRRSWSPI (SEQ ID NO: 3032) |

TABLE 18

CD19 CAR with GM-CSF PEBL Constructs (SEQ ID NOS 3077-3082, respectively)

| CD8a Leader | CD19 V_H | Linker | CD19 V_L | CD8a Hinge | CD28tm | CD28 Co-stim | CD3z | 2a | CD8a Leader | V_L | Linker | V_H | ER-Retention Domain and Tag | 2a | Tag |
|---|---|---|---|---|---|---|---|---|---|---|---|---|---|---|---|
| MALPVT ALLLPL ALLLHA ARP (SEQ ID NO: 1) | DIQMTQTTS SLSASLGDR VTISCRASQ DISKYLNWY QQKPDGTVK LLIYHTSRL HSGVPSRFS GSGSGTDYS LTISNLEQE DIATYFCQQ GNTLPYTFG GGTKLEITR ADAAPTVSI FPPSSN (SEQ ID NO: 3033) | GGGGS4 (SEQ ID NO: 9) | EVKLQESGP GLVAPSQSL SVTCTVSGV SLPDYGVSW IRQPPRKGL EWLGVIWGS ETTYYNSAL KSRLTIIKD NSKSQVFLK MNSLQTDDT AIYYCAKHY YYGGSYAMD YWGQGTSVS (SEQ ID NO: 3034) | TTTPAPRPP TPAPTIASQ PLSLRPEAC RPAAGGAVH TRGLDFACD (SEQ ID NO: 3035) | FWVLVVVGG VLACYSLLV TVAFIIFWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGK PRRKNPQE GLYNELQK DKMAEYAS EIGMKGER RGKGHDG LYQGLSTA TKDTYDAL HMQALPPR (SEQ ID NO: 3038) | GSGATNFS LLKQAGDV EENPGP (SEQ ID NO: 3031) | MALPVT ALLLPL ALLLHA ARP (SEQ ID NO: 1) | DIELQTPP SVSVAPGQ TARISCSG DNLPGKYV HWYQQKPG QAPVLVIY YDSNRPSG IPERFSGS NSGNTATL TISGTQAE DEADYYCQ SRTQTTIV FGGGTKLT VLGQ (SEQ ID NO: 3026) | GGGGS(n)n = 1, 2, 3, 4 (SEQ ID NO: 3069) | QVQLVESG GGLVQPGG SLRLSCAA SGFTFSSH WMSWVRQA PGKGLEWV SNIWRGPY IYYADSVK GRFTISRD NSKNTLYL QMNSLRAE DTAVYYCA RFQGYGGG FDYWGQGT LVTVSS (SEQ ID NO: 3027) | EQKLISEE DLKDEL (SEQ ID NO: 3028) | | |
| MALPVT ALLLPL ALLLHA ARP (SEQ ID NO: 1) | DIQMTQTTS SLSASLGDR VTISCRASQ DISKYLNWY QQKPDGTVK LLIYHTSRL HSGVPSRFS GSGSGTDYS LTISNLEQE DIATYFCQQ GNTLPYTFG GGTKLEITR ADAAPTVSI FPPSSN (SEQ ID NO: 3033) | GGGGS4 (SEQ ID NO: 9) | EVKLQEQGP GLVAPSQSL SVTCTVSGV SLPDYGVSW IRQPPRKGL EWLGVIWGS ETTYYNSAL KSRLTIIKD NSKSQVFLK MNSLQTDDT AIYYCAKHY YYGGSYAMD YWGQGTSVS (SEQ ID NO: 3034) | TTTPAPRPP TPAPTIASQ PLSLRPEAC RPAAGGAVH TRGLDFACD (SEQ ID NO: 3035) | FWVLVVVGG VLACYSLLV TVAFIIFWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGK PRRKNPQE GLYNELQK DKMAEYAS EIGMKGER RRGKGHDG LYQGLSTA TKDTYDAL HMQALPPR (SEQ ID NO: 3038) | GSGATNFS LLKQAGDV EENPGP (SEQ ID NO: 3031) | MALPVT ALLLPL ALLLHA ARP (SEQ ID NO: 1) | DIELQTPP SVSVAPGQ TARISCSG DNLPGKYV HWYQQKPG QAPVLVIY YDSNRPSG IPERFSGS NSGNTATL TISGTQAE DEADYYCQ SRTQTTIV FGGGTKLT VLGQ (SEQ ID NO: 3026) | GGGGS(n)n = 1, 2, 3, 4 (SEQ ID NO: 3069) | QVQLVESG GGLVQPGG SLRLSCAA SGFTFSSH WMSWVRQA PGKGLEWV SNIWRGPY IYYADSVK GRFTISRD NSKNTLYL QMNSLRAE DTAVYYCA RFQGYGGG FDYWGQGT LVTVSS (SEQ ID NO: 3027) | (GGGGS)4 AEKDEL (SEQ ID NO: 3029) | | |
| MALPVT ALLLPL ALLLHA ARP (SEQ ID NO: 1) | DIQMTQTTS SLSASLGDR VTISCRASQ DISKYLNWY QQKPDGTVK LLIYHTSRL HSGVPSRFS GSGSGTDYS | GGGGS4 (SEQ ID NO: 9) | EVKLQEQGP GLVAPSQSL SVTCTVSGV SLPDYGVSW IRQPPRKGL EWLGVIWGS ETTYYNSAL KSRLTIIKD | TTTPAPRPP TPAPTIASQ PLSLRPEAC RPAAGGAVH TRGLDFACD (SEQ ID NO: 3035) | FWVLVVVGG VLACYSLLV TVAFIIFWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGK PRRKNPQE GLYNELQK | GSGATNFS LLKQAGDV EENPGP (SEQ ID NO: 3031) | MALPVT ALLLPL ALLLHA ARP (SEQ ID NO: 1) | DIELQTPP SVSVAPGQ TARISCSG DNLPGKYV HWYQQKPG QAPVLVIY YDSNRPSG IPERFSGS | GGGGS(n)n = 1, 2, 3, 4 (SEQ ID NO: 3069) | QVQLVESG GGLVQPGG SLRLSCAA SGFTFSSH WMSWVRQA PGKGLEWV SNIWRGPY IYYADSVK | TTTPAPRP PTPAPTIA SQPLSLRP EACRPAAG AAVHTRGL DFACDIYI WAPLAGTC GVLLLSLV | | |

TABLE 18-continued

CD19 CAR with GM-CSF PEBL Constructs (SEQ ID NOS 3077-3082, respectively)

| CD8a Leader | CD19 V_H | Linker | CD19 V_L | CD8a Hinge | CD28tm | CD28 Co-stim | CD3z | 2a | CD8a Leader | V_L | Linker | V_H | ER-Retention Domain and Tag | 2a | Tag |
|---|---|---|---|---|---|---|---|---|---|---|---|---|---|---|---|
| | | | | | | | DKMAEAYS EIGMKGER RRGKGHDG LYQGLSTA TKDTYDAL HMQALPPR (SEQ ID NO: 3038) | | | NSGNTATL TISGTQAE DEADYYCQ SRTQTTIV FGGGTKLT VLGQ (SEQ ID NO: 3026) | | GRFTISRD NSKNTLYL QMNSLRAE DTAVYYCA RFQGYGGG FDYWGQGT LVTVSS (SEQ ID NO: 3027) | ITLYCNHR NLYKYKSR RSFIDEKK MP (SEQ ID NO: 3030) | | |
| MALPVT ALLLPL ALLLHA ARP (SEQ ID NO: 1) | DIQMTQTTS SLSASLGDR VTISCRASQ DISKYLNWY QQKPDGTVK LLIYHTSRL HSGVPSRFS GSGSGTDYS LTISNLEQE DIATYFCQQ GNTLPYTFG GGTKLEITR ADAAPTVSI FPPSSN (SEQ ID NO: 3033) | GGGGS (SEQ ID NO: 9) | DIQMTQTTS SLSASLGDR VTISCRASQ DISKYLNWY QQKPDGTVK LLIYHTSRL HSGVPSRFS GSGSGTDYS LTISNLEQE DIATYFCQQ GNTLPYTFG GGTKLEITR ADAAPTVSI FPPSSN (SEQ ID NO: 3033) | EVKLQESGP GLVAPSQSL SVTCTVSGV SLPDYGVSW IRQPPRKGL EWLGVIWGS ETTYYNSAL KSRLTIIKD NSKSQVFLK MNSLQTDDT AIYYCAKHY YYGGSYAMD YWGQGTSVS (SEQ ID NO: 3034) | TTTPAPRPP TPAPTIASQ PLSLRPEAC RPAAGGAVH TRGLDFACD (SEQ ID NO: 3035) | FWVLVVGG VLACYSLLV TVAFIIFWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGGK PRRKNPQE GLYNELQK DKMAEAYS EIGMKGER RRGKGHDG LYQGLSTA TKDTYDAL HMQALPPR (SEQ ID NO: 3038) | GSGATNFS LLKQAGDV EENPGP (SEQ ID NO: 3031) | MALPVT ALLLPL ALLLHA ARP (SEQ ID NO: 1) | DIELQTPP SVSVAPGQ TARISCSG DNLPGKYV HWYQQKPG QAPVLVIY YDSNRPSG IPERFSGS NSGNTATL TISGTQAE DEADYYCQ SRTQTTIV FGGGTKLT VLGQ (SEQ ID NO: 3026) | GGGGS(n)= 1, 2, 3, 4 (SEQ ID NO: 3069) | QVQLVESG GGLVQPGG SLRLSCAA SGFTFSSH WMSWVRQA PGKGLEWV SNIWRGPY IYYADSVK GRFTISRD NSKNTLYL QMNSLRAE DTAVYYCA RFQGYGGG FDYWGQGT LVTVSS (SEQ ID NO: 3027) | EQKLISEE DLKDEL (SEQ ID NO: 3028) | GSGATN FSLLKQ AGDVEE NPGP (SEQ ID NO: 3031) | MPRGWTA LCLLSLL PSGFMSL DNNGTAT PELPTQG TFSNVST NVSYQET TTPSTLG STSLHPV SQHGNEA TTNITET TVKFTST SVITSVY GNTNSSV QSQTSVI STVFTTP ANVSTPE TTLKPSL SPGNVSD LSTTSTS LATSPTK PYTSSSP ILSDIKA EIKCSGI REVKLTQ GICLEQN KTSSCAE FKKDRGE GLARVLC GEEQADA DAGAQVC SLLLAQS EVRPQCL LLVLANR TEISSKL QLMKHQ |

TABLE 18-continued

CD19 CAR with GM-CSF PEBL Constructs (SEQ ID NOS 3077-3082, respectively)

| CD8a Leader | CD19 V$_H$ | Linker | CD19 V$_L$ | CD8a Hinge | CD28tm | CD28 Co-stim | CD3z | 2a | CD8a Leader | V$_L$ | Linker | V$_H$ | ER-Retention Domain and Tag | 2a | Tag |
|---|---|---|---|---|---|---|---|---|---|---|---|---|---|---|---|
| MALPVT ALLLPL ALLLHA ARP (SEQ ID NO: 1) | DIQMTQTTS SLSASLGDR VTISCRASQ DISKYLNWY QQKPDGTVK LLIYHTSRL HSGVPSRFS GSGSGTDYS LTISNLEQE DIATYFCQQ GNTLPYTFG GGTKLEITR ADAAPTVSI FPPSSN (SEQ ID NO: 3033) | GGGGS$_4$ (SEQ ID NO: 9) | EVKLQEQGP GLVAPSQSL SVTCTVSGV SLPDYGVSW IRQPPRKGL EWLGVIWGS ETTYYNSAL KSRLTIIKD NSKSQVFLK MNSLQTDDT AIYYCAKHY YYGGSYAMD YWGQGTSVS (SEQ ID NO: 3034) | TTTPAPRPP TPAPTIASQ PLSLRPEAC RPAAGGAVH TRGLDFACD (SEQ ID NO: 3035) | FWVLVVVGG VLACYSLLV TVAFIIFWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGGK PRRKNPQE GLYNELQK DKMAEAYS EIGMKGER RRGKGHDG LYQGLSTA TKDTYDAL HMQALPPR (SEQ ID NO: 3038) | GSGATNFS LLKQAGDV EENPGP (SEQ ID NO: 3031) | MALPVT ALLLPL ALLLHA ARP (SEQ ID NO: 1) | DIELQTPP SVSVAPGQ TARISCSG DNLPGKYV HWYQQKPG QAPVLIIY YDSNRPSG IPERFSGS NSGNTATL TISGTQAE DEADYYCQ SRTQTTIV FGGGTKLT VLGQ (SEQ ID NO: 3026) | GGGGS(n) = 1, 2, 3, 4 (SEQ ID NO: 3069) | QVQLVESG GGLVQPGG SLRLSCAA SGFTFSSH WMSWVRQA PGKGLEWV SNIWRGPY IYYADSVK GRFTISRD NSKNTLYL QMNSLRAE DTAVYYCA RFQGYGGG FDYWGQGT LVTVSS (SEQ ID NO: 3027) | (GGGGS)$_4$ AEKDEL (SEQ ID NO: 3029) | GSGATN FSLLKQ AGDVEE NPGP (SEQ ID NO: 3031) | MPRGWTA LCLLSLL PSGFMSL DNNGTAT PELPTQG TFSNVST NVSYQET TTPSTLG STSLHPV SQHGNEA TTNIETT TVKFTST SVITSVY GNTNSSV QSQTSVI STVFTTP ANVSTPE TTLKPSL SPGNVSD LSTTSTS LATSPTK PYTSSSP ILSDIKA EIKCSGI REVKLTQ GICLEQN KTSSCAE FKKDRGE GLARVLC GEEQADA DAGAQVC SLLAQS EVRPQCL LLVLANR TEISSKL SDLKKLG ILDFTEQ DVASHQS YSQKTLI ALVTSGA LLAVLGI TGYFLMN RRSWSPI (SEQ ID NO: 10) |

TABLE 18-continued

CD19 CAR with GM-CSF PEBL Constructs (SEQ ID NOS 3077-3082, respectively)

| CD8a Leader | CD19 V_H | Linker | CD19 V_L | CD8a Hinge | CD28tm | CD28 Co-stim | CD3z | 2a | CD8a Leader | V_L | Linker | V_H | ER-Retention Domain and Tag | 2a | Tag |
|---|---|---|---|---|---|---|---|---|---|---|---|---|---|---|---|
| MALPVT ALLLPL ALLLHA ARP (SEQ ID NO: 1) | DIQMTQTTS SLSASLGDR VTISCRASQ DISKYLNWY QQKPDGTVK LLIYHTSRL HSGVPSRFS GSGSGTDYS LTISNLEQE DIATYFCQQ GNTLPYTFG GGTKLEITR ADAAPTVSI FPPSSN (SEQ ID NO: 3033) | GGGGS_4 (SEQ ID NO: 9) | EVKLQEQGP GLVAPSQSL SVTCTVSGV SLPDYGVSW IRQPPRKGL EWLGVIWGS ETTYYNSAL KSRLTIIKD NSKSQVFLK MNSLQTDDT AIYYCAKHY YYGGSYAMD YWGQGTSVS (SEQ ID NO: 3034) | TTTPAPRPP TPAPTIASQ PLSLRPEAC RPAAGGAVH TRGLDFACD (SEQ ID NO: 3035) | FWVLVVVGG VLACYSLLV TVAFIIFWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGGK PRRKNPQE GLYNELQK DKMAEAYS EIGMKGER RRGKGHDG LYQGLSTA TKDTYDAL HMQALPPR (SEQ ID NO: 3038) | GSGATNFS LLKQAGDV EENPGP (SEQ ID NO: 3031) | MALPVT ALLLPL ALLLHA ARP (SEQ ID NO: 1) | DIELQTPP SVSVAPGQ TARISCSG DNLPGKYV HWYQQKPG QAPVLVIY YDSNRPSG IPERFSGS NSGNTATL TISGTQAE DEADYYCQ SRTQTTIV FGGGTKLT VLGQ (SEQ ID NO: 3026) | GGGGS(n) = 1, 2, 3, 4 (SEQ ID NO: 3069) | QVQLVESG GGLVQPGG SLRLSCAA SGFTFSSH WMSWVRQA PGKGLEWV SNIWRGPY IYYADSVK GRFTISRD NSKNTLYL QMNSLRAE DTAVYYCA RFQGYGGG FDYWGQGT LVTVSS (SEQ ID NO: 3027) | TTTPAPRP PTPAPTIA SQPLSLRP EACRPAAG AAVHTRGL DFACDIYI WAPLAGTC GVLLLSLV ITLYCNHR NLYKYKSR RSFIDEKK MP (SEQ ID NO: 3030) | GSGATN FSLLKQ AGDVEE NPGP (SEQ ID NO: 3031) | MPRGWTA LCLLSLL PSGFMSL DNNGTAT PELPTQG TFSNVST NVSYQET TTPSTLG STSLHPV SQHGNEA TTNITET TVKFTST SVITSVY GNTNSSV QSQTSVI STVFTTP ANVSTPE TTLKPSL SPGNVSD LSTTSTS LATSPTK PYTSSSP ILSDIKA EIKCSGI REVKLTQ QLMKKHQ SDLKKLG ILDFTEQ DVASHQS YSQKTLI ALVTSGA LLAVLGI TGYFLMN RRSWSPI (SEQ ID NO: 10) |

TABLE 18-continued

CD19 CAR with GM-CSF PEBL Constructs (SEQ ID NOS 3077-3082, respectively)

| CD8a Leader | CD19 V_H | Linker | CD19 V_L | CD8a Hinge | CD28tm | CD28 Co-stim | CD3z | 2a | CD8a Leader | V_L | Linker | V_H | ER-Retention Domain and Tag | 2a | Tag |
|---|---|---|---|---|---|---|---|---|---|---|---|---|---|---|---|
| | | | | | | | | | | | | | | | GICLEQN KTSSCAE FKKDRGE GLARVLC GEEQADA DAGAQVC SLLLAQS EVRPQCL LLVLANR TEISSKL QLMKKHQ SDLKKLG ILDFTEQ DVASHQS YSQKTLI ALVTSGA LLAVLGI TGYFLMN RRSWSPI (SEQ ID NO: 10) |

Example 17—In Vitro CRS Assay for Testing Efficacy of Inducing CRS after Deletion of GM-CSF in CART19

Cell lines: CD19 positive B-ALL cell line RAMOS was used to evaluate CRS in an in vitro assay. Prior to assay, RAMOS cells were stably transfected with GFP using lentiviral transduction and cultured in RPMI+10% FBS+Pen/Strep.

Isolation of normal donor monocytes and T cells: Primary human T cells and monocytes were isolated from normal healthy human donors. T cell cells were isolated from PBMC using CD4+CD8+ selection (Miltenyi Biotec) and monocytes were separated using Miltenyi biotec classical Monocyte Isolation beads according to the manufactures protocol.

T cell culture and CAR-T gene editing: T cells were subsequently resuspended at a concentration of $1 \times 10^6$ cells/mL in Xcyte media supplemented with 50 U/mL IL-2 and 10 ng/ml IL-15 in the presence of anti-CD3/CD28 beads (Bead to cell ratio 3:1). Twenty-four hours after initial stimulation, T cells were transfected with lentiviral vector encoding the CD19 CAR construct in the presence of polybrene (final conc. 6 μg/ml). Stimulatory beads were removed on day 2. CART19 cells were suspended at $4 \times 10^6$ T cells were electroporated in 100 μl buffer P3 with 15 μg spCas9 mRNA (Trilink CA.) and 20 μg of GM-CSF gRNA (Trilink) using a nucleofector 4D, program EO-115. Control CAR19 T cells were electroporated without GM-CSF gRNA. T-cells were subsequently evaluated at day 6 for CD34 (bicistronic marker of CAR-T) and intracellular GM-CSF expression using flowcytometry prior to co-culture assay.

Production of monocyte lineage cells: For iDC generation, monocytes ($1 \times 10^6$) were plated in 6 mLs of RPMI 1640 supplemented with supplemented with 0.1 mmol/L MEM Non-Essential Amino Acids, 2 mmol/L L-glutamine, 100 units/mL penicillin, 100 μg/mL streptomycin (Life Technologies) and 10% fetal calf serum (cR10). cR10 was subsequently supplemented with 0.2 μg/mL human IL-4 (Peptotec) and 0.2 μg/mL GM-CSF (Peptotec).

For macrophage and activated macrophage generation cR10 was supplemented with 10% human A/B serum instead of fetal calf serum (hR10). For activated macrophages hR10 medium was supplemented with 30 ng/ml of LPS. On day 4 cytokines and LPS were replenished. Macrophages, activated macrophages and iDC were harvested using 2 mmol/L EDTA (immature dendritic cells) on day 6 post-isolation. Twenty-four hours later, cells were harvested with 2 mmol/L EDTA and stained with CD45, CD80 and CD86 to confirm immature DC and mature DC differentiation.

Co-culture assay: CAR-T cells were combined at the following ratios in 200 μl per 96 well: 12.5K UCART-19 (with or with-out GM-CSF KO), Target, 50K Ramos cells (CD19+) and monocyte derived cells, 1K iDC or 5K macrophages or 5K activated macrophages.

Co-cultures were subsequently incubated for at 37° C. and 100 μl of assay supernatant was collected at 24 hr and 48 hr for cytokine analysis.

Measurement of Cytokine Levels

Cytokine concentration determination from culture supernatants was performed using IL-6 ELISA plate (R&D systems). Prior to analysis supernatant's were centrifuged at 300 g for 10 mins at 4° C. and subsequently diluted 1:10 in assay calibrator diluent. Measurements were performed using standard product protocols.

Figure 8:
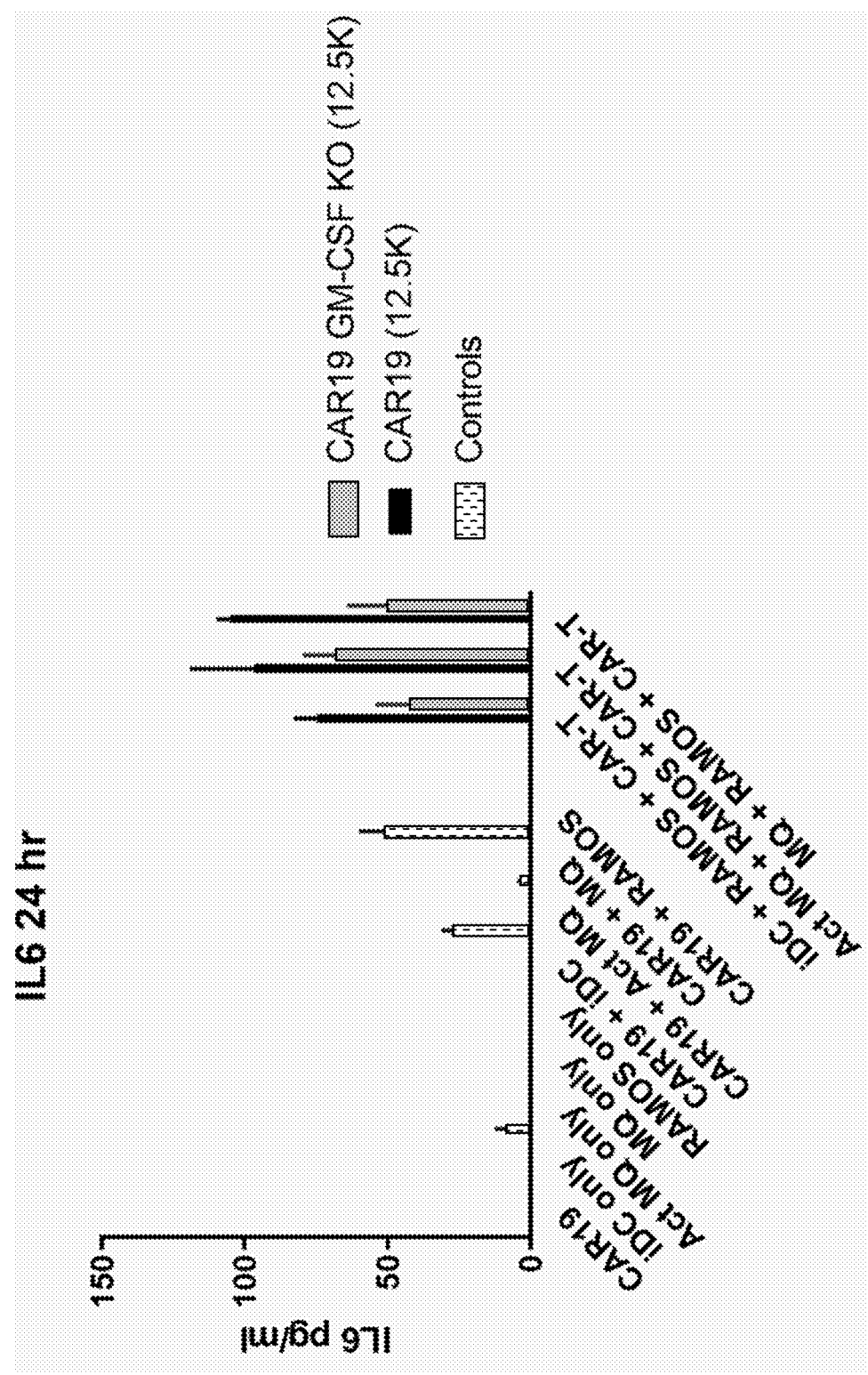
FIG. 8—Shows IL-6 expression in CAR19, iDC only, Act MQ only, MC only, RAMOS only, CAR19+iDC, CAR19+ActMQ, CAR19+MQ, CAR19+RAMOS, iDC+RAMOS+CAR-T, ActMQ+RAMOS+CAR-T, and MQ+RAMOS+CAR-T for CAR19 GM-CSF knock-out, CAR19, and controls at 24 hours.
Figure 10:
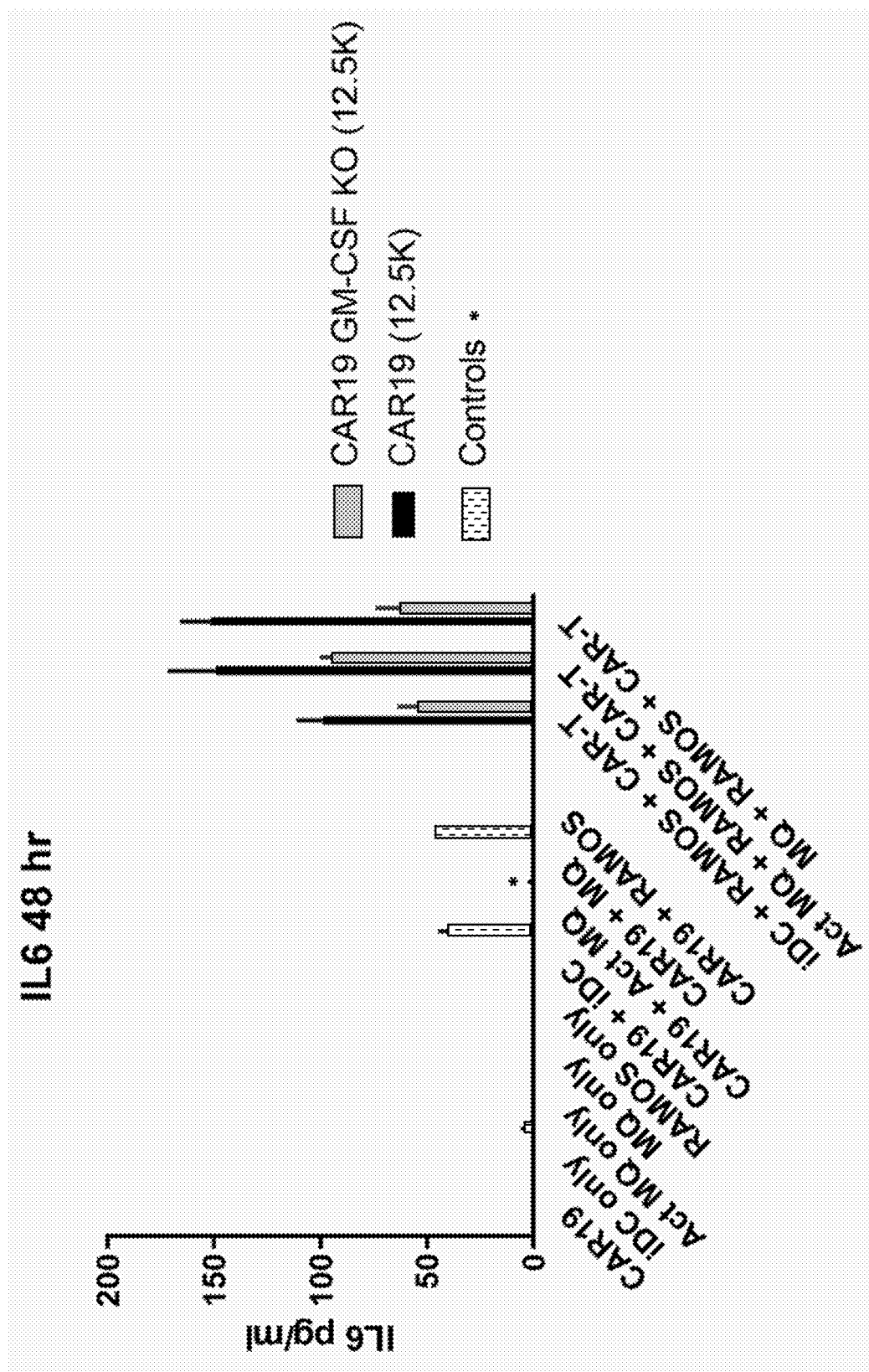
FIG. 10—Shows IL-6 expression in CAR19, iDC only, Act MQ only, MC only, RAMOS only, CAR19+iDC, CAR19+ActMQ, CAR19+MQ, CAR19+RAMOS, iDC+RAMOS+CAR-T, ActMQ+RAMOS+CAR-T, and MQ+RAMOS+CAR-T for CAR19 GM-CSF knock-out, CAR19, and controls at 48 hours.

GM-CSF deficient CART19 induced significantly lower il-6 expression across the different monocyte lineages. FIGS. 8 and 10

Example 18—In Vitro CRS Assay for Testing Efficacy of Inducing CRS after Deletion of GM-CSF in T Cells Isolation of normal donor monocytes and T cells: Primary human T cells and monocytes were isolated from normal healthy human donors. T cell cells were isolated from PBMC using CD4+CD8+ selection (Miltenyi Biotec) and monocytes were separated using Miltenyi Biotec classical Monocyte Isolation beads according to the manufactures protocol.

T cell culture and gene editing: T cells were subsequently resuspended at a concentration of $10^6$ cells/mL in Xcyte media supplemented with 50 U/mL IL-2 and 10 ng/ml IL-15 in the presence of anti-CD3/CD28 beads (Bead to cell ratio 3:1) (Life Technologies, catalog #111.32D). Twenty-four hours after initial stimulation. Stimulatory beads were removed on day 2. $4 \times 10^6$ T cells were electroporated in 100 μl buffer P3 with 15 μg spCas9 mRNA (Trilink CA.) and 20 μg of TRAC gRNA (Trilink) using a nucleofector 4D, program EO-115. Control CAR19 T cells were electroporated without GM-CSF gRNA. T-cells were subsequently evaluated at day 6 for GM-CSF expression prior to co-culture assay using flowcytometry.

Production of monocyte lineage cells: For iDC generation, monocytes ($1 \times 10^6$) were plated in 6 mLs of RPMI 1640 supplemented with supplemented with 0.1 mmol/L MEM Non-Essential Amino Acids, 2 mmol/L L-glutamine, 100 units/mL penicillin, 100 μg/mL streptomycin (Life Technologies) and 10% fetal calf serum (cR10). cR10 was subsequently supplemented with 0.2 μg/mL human IL-4 (Peptotec) and 0.2 μg/mL GM-CSF (Peptotec). On day 4 cytokines and LPS were replenished. IDC were harvested using 2 mmol/L EDTA (immature dendritic cells) on day 6 post-isolation.

Co-culture assay: T cells were combined at the following ratios in 200 μl per 96 well: 12.5K T cells (with or with-out GM-CSF KO), 50K anti-CD3/CD28 beads and 1K iDC Co-cultures were subsequently incubated for at 37° C. and 100 μl of assay supernatant was collected at 24 hr and 48 hr for cytokine analysis.

Measurement of cytokine levels: Cytokine concentration determination from culture supernatants was performed using IL-6 ELISA plate (R&D systems). Prior to analysis supernatants were centrifuged at 300×g for 10 mins at 4° C. and subsequently diluted 1:10 in assay calibrator diluent. Measurements were performed using standard product protocols.

Figure 7:
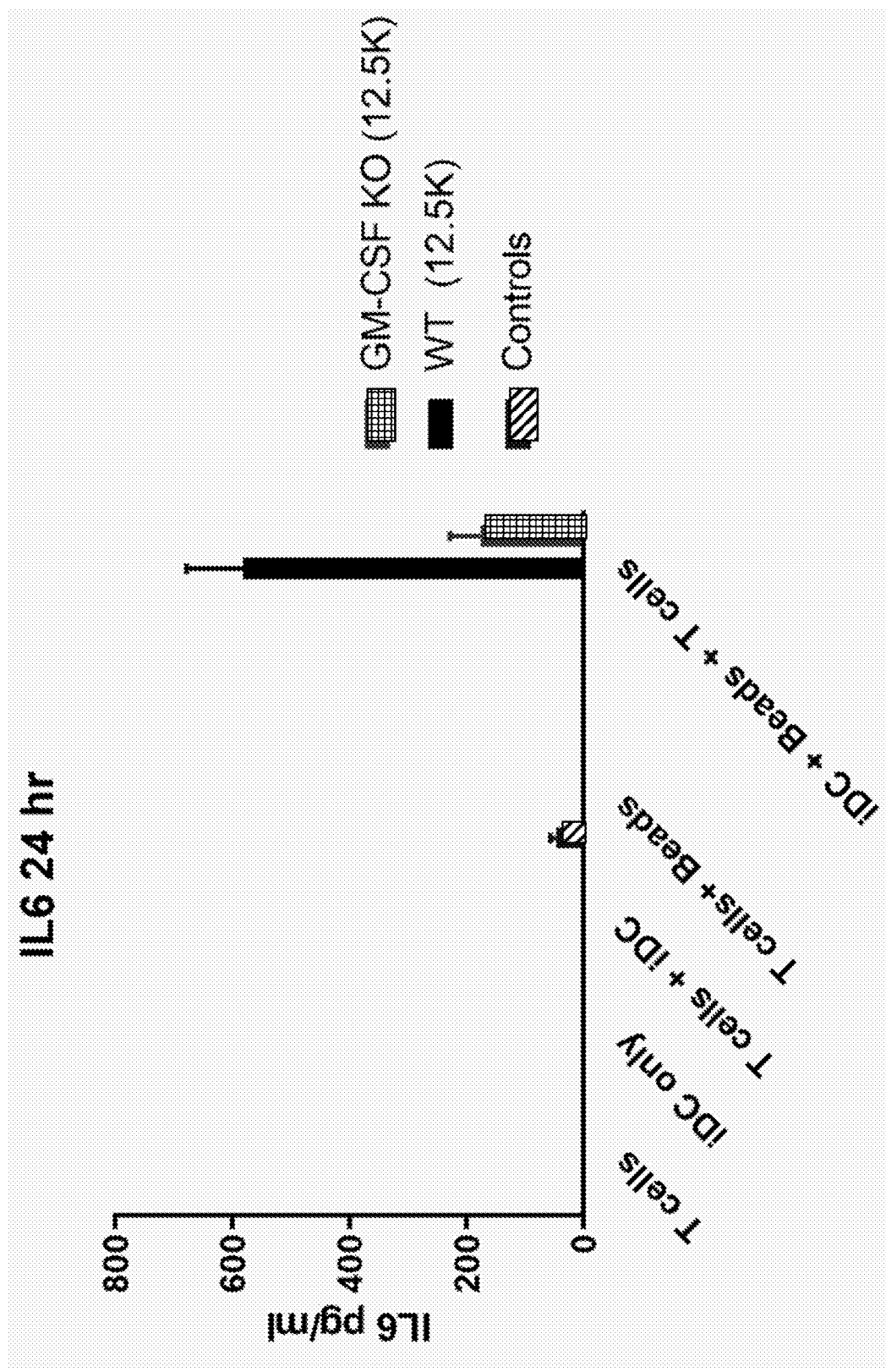
FIG. 7—Shows IL-6 expression in T cells, iDC cells, T cells+iDC, T cells+beads, and iDC+beads+ T cells for GM-CSF knock-out, wild-type, and controls at 24 hours.
Figure 9:
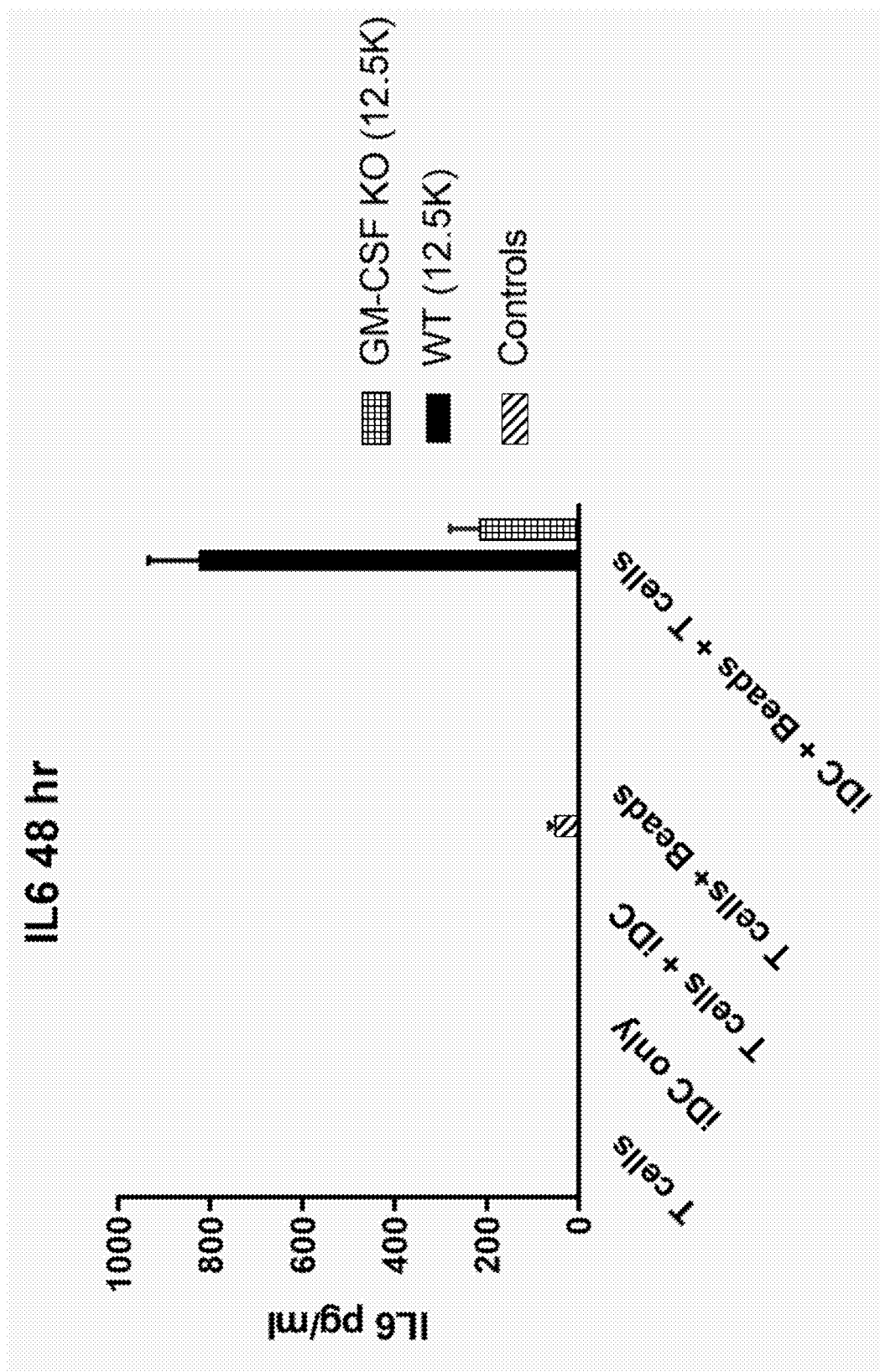
FIG. 9—Shows IL-6 expression in T cells, iDC cells, T cells+iDC, T cells+beads, and iDC+beads+ T cells for GM-CSF knock-out, wild-type, and controls at 48 hours.

Deletion of GM-CSF reduced IL-6 production >3-fold at 24 hrs (FIGS. 7 and 8) and >4-fold at 48 hrs (FIGS. 9 and 10) relative to non-edited T cells.

GM-CSF deficient T cells induced significantly lower IL-6 expression across the different monocyte lineages.

Example 19—Method for Making and Testing a Genome-Edited CAR-T Cell Deficient at Inducing CRS by Insertion of Selectable Marker into Gene Edited Locus Inject primary B-ALL ($2 \times 10^6$) in NSG mice if performing an in vivo CRS experiment. This should be completed 3 weeks prior to infusion of CAR-T into mice.

The following steps may be taken to provide a genome-edited, CRS-resistant, CAR-T cells. This example describes the making of a CD19CARTΔGMCSFΔCD3ε mutant IL-7R T cell, in which the deletion of GM-CSF mitigates risk of CRS, deletion of CD3e prevent TCR signaling and GvHD and the mutant IL-7R enhances proliferation of the CAR-T sufficiently to induce CRS in this model. Sequences encoding a mutant, constitutively active IL-7R sequence can be found in Table 19, or found in the art. As those of skill in the art will recognize, certain of the steps may be conducted sequentially or out of the order listed below, though perhaps leading to different efficiency.

Step 1: T Cell Activation (Day 0)

Purify T cells from a leukapheresis chamber using a Miltenyi human PanT isolation kit. Resuspend in media. Count cells. Determine the number of human T cell activation CD3/CD28 beads required to obtain a 3:1 bead: cell ratio. Wash beads 2× with T cell media. Dilute cells at 1.256 cells/mL in hXcyte media. Add human T cell activation CD3/CD28 beads. Aliquot 4 mL/well of 1.256 cell/mL solution into a 6 well plate. Incubate cells at 37° C.

Step 2: T Cell Transduction (Day 1)

CAR-T cells may then be transduced with one or more CARs targeted to (i.e., that recognizes) one or more targets, for example with a lentivirus containing a CAR construct. Any other suitable method of transduction may be used.

Step 3: CRISPR (Day 2)

In a CRS-resistant CAR-T cell, cytokine/chemokine/transcription factor genes or transcription factors may be deleted to prevent secretion of factors that induce secretion of cytokines from myeloid cells. Deletion may be accomplished by electroporating with Cas9 mRNA and gRNA against the target(s). Other techniques, however, could be used to suppress expression of the target. These include other genome editing techniques such as TALENs, RNA interference, and eliciting of internal binding of the antigen to prevent cell surface expression. Examples of gRNAs that may be used include those shown in Tables 8-10, and others known in the art.

| Sample ID | gRNA#1 | gRNA#2 | Cas9 | Nuecleofection Buffer P3 |
|---|---|---|---|---|
| UCART19 | 20 μg gGM-CSF | 20 μg gCD3ε | 15 μg Cas9 mRNA | 100 μl |

Cells are harvested, isolated, and purified, for example using magnetic selection with a labelled antibody-coated magnetic beads that bind to a cell-specific protein (available from, e.g., Miltenyi Biotec). For T cells, anti-CD3/CD28 beads could be used. Other purification techniques are known in the art and could be used.

TABLE 19

Sequences or Constitutively Expressing IL-7R

| CD8a Leader | CD19 V_L | Linker | CD19 V_H | CD8a Hinge | CD28tm | CD28 Co-stim | CD3z | 2a | Truncated CD34 | Truncated IL-7R ECD | IL-7 TMD | Trucated IL-7R ICD | Description |
|---|---|---|---|---|---|---|---|---|---|---|---|---|---|
| MALPVT ALLLPL ALLLHA ARP (SEQ ID NO: 1) | DIQMTQTT SSLSASLG DRVTISCR ASQDISKY LNWYQQKP DGTVKLLI YHTSRLHS GVPSRFSG SGSGTDYS LTISNLEQ QGNTLPYT FGGGTKLE ITRADAAP TVSIFPPS SN (SEQ ID NO: 3033) | GGGGS_4 (SEQ ID NO: 9) | EVKLQESGP GIVAPSQSL SVTCTVSGV SLPDYGVSW IRQPPRKGL EWLGVIWGS ETTYYNSAL KSRLKSRLT IIKDNSKSQ VFLKMNSLQ TDDTAIYYC AKHYYYGGS YAMDYWGQG TSVTVSS (SEQ ID NO: 3034) | TTTPAPRPP TPAPTIASQ PLSLRPEAC RPAAGGAVH TRGLDFACD (SEQ ID NO: 3035) | FWVLVVVG GVLACYSL LVTVAFII FWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGGK PRRKNPQE GLYNELQK SQHGNEATT DKMAEAYS EIGMKGER RRGKGHDG LYQGLSTA TKDTYDAL HMQALPPR (SEQ ID NO: 3038) | GSGATNFS LLKQAGDV EENPGP (SEQ ID NO: 3031) | MPRGWTALC LLSLLPSGF MSLDNNGTA TPELPTQGT FSNVSTNVS YQETTTPST LGSTSLHPV SQHGNEATT NITETTVKF TSTSVITSV YGNTNSSVQ SQTSVISTV FTTPANVST PETTLKPSL LPSNVSDLS TTSTSLATS PTKPYTSSS PILSDIKAE IKCSGIREV KLTQGICLE QNKTSSCAE FKKDRGEGL ARVLCGEEQ ADADAGAQV CSLLIAQSE VRPQCLLIV LANRTEISS KLQLMKKHQ SDLKKLG (SEQ ID NO: 3039) | YREGANDFV VTFNTSHLQ KKYVKVLMH DVAYRQEKD ENKWTHVNL SSTKLTLLQ RKLQPAAMY EIKVRSIPD HYFKGFWSE WSPSYFRT PEINNSSGE MDPI (SEQ ID NO: 3040) | LLTCPTISI LSFFSVALL VILACVLW (SEQ ID NO: 3045) | KKRIKPIVW PSLPDHKKT LEHLCKKPR KNLNVSFNP ESFLDCQIH RVDDIQARD EVEGFLQDT FPQQLEESE KQRLGGDVQ SPNCPSEDV VITPESFGR DSSLTCLAG NVSACDAPI LSSSRSLDC RESGKNGPH VYQDLLLSL GTTNSTLPP PFSLQSGIL TLNPVAQGQ PILTSLGSN QEEAYVTMS SFYQNQ (SEQ ID NO: 3047) | IL7R with L5 and L6 elbows with CPT transmembrane T-ALL mutation insertion only |
| MALPVT ALLLPL ALLLHA ARP (SEQ ID NO: 1) | DIQMTQTT SSLSASLG DRVTISCR ASQDISKY LNWYQQKP DGTVKLLI YHTSRLHS GVPSRFSG SGSGTDYS LTISNLEQ QGNTLPYT FGGGTKLE ITRADAAP | GGGGS_4 (SEQ ID NO: 9) | EVKLQESGP GIVAPSQSL SVTCTVSGV SLPDYGVSW IRQPPRKGL EWLGVIWGS ETTYYNSAL KSRLKSRLT IIKDNSKSQ VFLKMNSLQ TDDTAIYYC AKHYYYGGS YAMDYWGQG | TTTPAPRPP TPAPTIASQ PLSLRPEAC RPAAGGAVH TRGLDFACD (SEQ ID NO: 3035) | FWVLVVVG GVLACYSL LVTVAFII FWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGGK PRRKNPQE GLYNELQK SQHGNEATT DKMAEAYS EIGMKGER RRGKGHDG LYQGLSTA TKDTYDAL | GSGATNFS LLKQAGDV EENPGP (SEQ ID NO: 3031) | MPRGWTALC LLSLLPSGF MSLDNNGTA TPELPTQGT FSNVSTNVS YQETTTPST LGSTSLHPV SQHGNEATT NITETTVKF TSTSVITSV YGNTNSSVQ SQTSVISTV FTTPANVST | YREGANDFV VTFNTSHLQ KKYVKVLMH DVAYRQEKD ENKWTHVNL SCTKLTLLQ RKLQPAAMY EIKVRSIPD HYFKGFWSE WSPSYFRT PEINNSSGE MD (SEQ ID NO: 3045) | LLTCPTISI LSFFSVALL VILACVLW (SEQ ID NO: 3045) | KKRIKPIVW PSLPDHKKT LEHLCKKPR KNLNVSFNP ESFLDCQIH RVDDIQARD EVEGFLQDT FPQQLEESE KQRLGGDVQ SPNCPSEDV VITPESFGR DSSLTCLAG NVSACDAPI | IL7R with L5 and L6 elbows with CPT transmembrane T-ALL mutation insertion and S185C B-ALL mutation |

TABLE 19-continued

Sequences or Constitutively Expressing IL-7R

| CD8a Leader | CD19 V_L | Linker | CD19 V_H | CD8a Hinge | CD28tm | CD28 Co-stim | CD3z | 2a | Truncated CD34 | Truncated IL-7R ECD | IL-7 TMD | Trucated IL-7R ICD | Description |
|---|---|---|---|---|---|---|---|---|---|---|---|---|---|
| MALPVT ALLLPL ALLHA ARP (SEQ ID NO: 1) | TVSIFPPS SN (SEQ ID NO: 3033) | | TSVTVSS (SEQ ID NO: 3034) | | | | HMQALPPR (SEQ ID NO: 3038) | | PETTLKPSL LPSNVSDLS TTSTSLATS PTKPYTSSS PILSDIKAE IKCSGIREV KLTQGICLE QNKTSSCAE FKKDRGEGL ARVLCGEEQ ADADAGAQV CSLLLAQSE VRPQCLLLV LANRTEISS KLQLMKKHQ SDLKKLG (SEQ ID NO: 3039) | | | LSSSRSLDC RESGKNGPH VYQDLLLSL GTTNSTLPP PFSLQSGIL TLNPVAGQ PILTSLGSN QEEAYVTMS SFYQNQ (SEQ ID NO: 3047) | |
| MALPVT ALLLPL ALLHA ARP (SEQ ID NO: 1) | DIQMTQT SSLSASLG DRVTISCR ASQDISKY LNWYQQKP DGTVKLLI YHTSRLHS GVPSRFSG SGSGTDYS LTISNLEQ QGNTLPYT FGGGTKLE ITRADAAP TVSIFPPS SN (SEQ ID NO: 3033) | GGGGS4 (SEQ ID NO: 9) | EVKLQESGP GLVAPSQSL SVTCTVSGV SLPDYGVSW IRQPPRKGL EWLGVIWGS ETTYYNSAL KSRLKSRLT IIKDNSKSQ VFLKMNSLQ TDDTAIYYC AKHYYYGGS YAMDYWGQG TSVTVSS (SEQ ID NO: 3034) | TTTPAPRPP TPAPTIASQ PLSLRPEAC RPAAGGAVH TRGLDFACD (SEQ ID NO: 3035) | FWVLVVVG GVLACYSL LVTVAFI FWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGGK PRRKNPQE GLYNELQK DKMAEAYS EIGMKGER RRGKGHDG LYQGLSTA TKDTYDAL HMQALPPR (SEQ ID NO: 3038) | GSGATNFS LLKQAGDV EENPGP (SEQ ID NO: 3031) | MPRGWTALC LLSLLPSGF MSLDNNGTA TPELPTQGT FSNVSTNVS YQETTTPST LGSTSLHPV SQHGNEATT NITETTVKF TSTSVITSV YGNTNSSVQ SQTSVISTV FTTPANVST PETTLKPSL LPSNVSDLS TTSTSLATS PTKPYTSSS PILSDIKAE IKCSGIREV KLTQGICLE | YREGANDFV VTFNTSHLQ KKYVKVLMH DVAYRQEKD ENKWTHVNL SCTKLTLLQ RKLQPAAMY EIKVRSIPD HYFKGFWSE WSPSYYFRT PEINNSSGE MD (SEQ ID NO: 3041) | LLTISILS FFSVALLV ILACVLM (SEQ ID NO: 3046) | KKRIKPIVW PSLPDHKKT LEHLCKKPR KNLNVSFNP ESFLDCQIH RVDDIQARD EVEGFLQDT FPQQLEESE KQRLGGDVQ SPNCPSEDV VITPESFGR DSSLITCLAG NVSACDAPI LSSSRSLDC RESGKNGPH VYQDLLLSL GTTNSTLPP PFSLQSGIL TLNPVAGQ PILTSLGSN | IL7R with L5 and L6 elbows with S185C B-ALL mutation only |

TABLE 19-continued

Sequences or Constitutively Expressing IL-7R

| CD8a Leader | CD19 V_L | Linker | CD19 V_H | CD8a Hinge | CD28tm | CD28 Co-stim | CD3z | 2a | Truncated CD34 | Truncated IL-7R ECD | IL-7 TMD | Trucated IL-7R ICD | Description |
|---|---|---|---|---|---|---|---|---|---|---|---|---|---|
| | | | | | | | | | QNKTSSCAE FKKDRGEGL ARVLCGEEQ ADADAGAQV CSLLIAQSE VRPQCLLLV LANRTEISS KLQLMKKHQ SDLKKLG (SEQ ID NO: 3039) | | | QEEAYVTMS SFYQNQ (SEQ ID NO: 3047) | |
| MALPVT ALLLPL ALLLHA ARP (SEQ ID NO: 1) | DIQMTQTT SSLSASLG DRVTISCR ASQDISKY LNWYQQKP DGTVKLLI YHTSRLHS GVPSRFSG SGSGTDYS LTISNLEQ QGNTLPYT FGGGTKLE ITRADAAP TVSIFPPS SN (SEQ ID NO: 3033) | GGGGS_4 (SEQ ID NO: 9) | EVKLQESGP GLVAPSQSL SVTCTVSGV SLPDYGVSW IRQPPRKGL EMLGVIWGS ETTYNSAL KSRLKSRLT IIKDNSKSQ VFLKMNSLQ TDDTAIYYC AKHYYYGGS YAMDYWGQG TSVTVSS (SEQ ID NO: 3034) | TTTPAPRPP TPAPTIASQ PLSLRPEAC RPAAGGAVH TRGLDFACD (SEQ ID NO: 3035) | FWVLVVVG GVLACYSL LVTVAFII FWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGGK PRRKNPQE GLYNELQK DKMAEAYS EIGMKGER RRGKGHDG LYQGLSTA TKDTYDAL HMQALPPR (SEQ ID NO: 3038) | GSGATNFS LLKQAGDV EENPGP (SEQ ID NO: 3031) | | MPRGWTALC LLSLLPSGF MSLDNNGTA TPELPTQGT FSNVSTNVS YQETTPST LGSTSLHPV SQHGNEATT NITETTVKF TSTSVTSV YGNTNSSVQ SQTSVISTV FTTPANVST PETTLKPSL LPSNVSDLS TTSTSLATS PTKPYTSSS PILSDIKAE IKCSGIREV KLTQGICLE QNKTSSCAE FKKDRGEGL ARVLCGEEQ ADADAGAQV CSLLIAQSE VRPQCLLLV LANRTEISS KLQLMKKHQ SDLKKLG (SEQ ID NO: 3039) | YREGANDFV VTFNTSHLQ KKYVKVLMH DVAYRQEKD ENKWTHVNL SSTKLTLLQ RKLQPAAMY EIKVRSIPD HYFKGFWSE WSPSYYFRT PEINNSSGE MDPI (SEQ ID NO: 3040) | LLTISILSF FSVALIVIL ACVLW (SEQ ID NO: 46) | KKRIKPIVW PSLPDHKKT LEHLCKKPR KNLNVSFNP ESFLDCQIH RVDDIQARD EVEGFLQDT FPQQLEESE KQRLGGDVQ SPNCPSEDV VITPESFGR DSSLTCLAG NVSACDAPI LSSSRSLDC RESGKNGPH VYQDLLLSL GTTNSTLPP PFSLQSGIL TLNPVAQGQ PILTSLGSN QEEAYVTMS SFYQNQ (SEQ ID NO: 3047) | IL7R with L5 and L6 elbows WT |
| MALPVT ALLLPL ALLLHA | DIQMTQTT SSLSASLG DRVTISCR | GGGGS_4 (SEQ ID NO: 9) | EVKLQESGP GLVAPSQSL SVTCTVSGV | TTTPAPRPP TPAPTIASQ PLSLRPEAC | FWVLVVVG GVLACYSL LVTVAFII | RSKRSRLLH SDYMNMTPR RPGPTRKHY | RVKFSRSA DAPAYKQG QNQLYNEL | GSGATNFS LLKQAGDV EENPGP | | MPRGWTALC LLSLLPSGF MSLDNNGTA | VNLSSTKLT LLQRKLQPA AMYEIKVRS | LLTCPTISI LSFFSVALL VILACVLW | KKRIKPIVW PSLPDHKKT LEHLCKKPR | IL7R with L6 elbow only with CPT transmembrane T-ALL |

TABLE 19-continued

Sequences or Constitutively Expressing IL-7R

| CD8a Leader | CD19 V_L | Linker | CD19 V_H | CD8a Hinge | CD28tm | CD28 Co-stim | CD3z | 2a | Truncated CD34 | Truncated IL-7R ECD | IL-7 TMD | Trucated IL-7R ICD | Description |
|---|---|---|---|---|---|---|---|---|---|---|---|---|---|
| MALPVT ALLLPL ALLLHA ARP (SEQ ID NO: 1) | ASQDISKY LNWYQQKP DGTVKLLI YHTSRLHS GVPSRFSG SGSGTDYS LTISNLEQ QGNTLPYT FGGGTKLE ITRADAAP TVSIFPPS SN (SEQ ID NO: 3033) | | EVKLQESGP GLVAPSQSL SVTCTVSGV SLPDYGVSW IRQPPRKGL EWLGVIWGS ETTYYNSAL KSRLKSRLT IIKDNSKSQ VFLKMNSLQ TDDTAIYYC AKHYYYGGS YAMDYWGQG TSVTVSS (SEQ ID NO: 3034) | TTTPAPRPP TPAPTIASQ PLSLRPEAC (SEQ ID NO: 3035) | FWVLVVVG GVLACYSL LVTVAFII FWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGGK PRRKNPQE GLYNELQK DKMAEAYS EIGMKGER RRGKGHDG LYQGLSTA TKDTYDAL HMQALPPR (SEQ ID NO: 3038) | GSGATNFS LLKQAGDV EENPGP (SEQ ID NO: 3031) | MPRGWTALC LLSLLPSGF MSLDNNGTA TPELPTQGT FSNVSTNVS YQETTTPST LGSTSLHPV SQHGNEATT NITETTVKF TSTSVITSV YGNTNSSVQ SQTSVISTV FTTPANVST PETTLKPSL LPSNVSDLS TTSTSLATS PTKPYTSSS PILSDIKAE | VNLSCTKLT LLQTKLQPA AMYEIKVRS IPDHYFKGF WSEWSPSYY FRTPEINNS SGEMDPI (SEQ ID NO: 3043) | LLTCPTISI LSFFSVALL VILACVLW (SEQ ID NO: 3045) | KKRIKPIVW PSLPDHKKT LEHLCKKPR KNLNVSFNP ESFLDCQIH RVDDIQARD EVEGFLQDT FPQQLEESE KQRLGGDVQ SPNCPSEDV VITPESFGR DSSLTCLAG NVSACDAPI LSSSRSLDC RESGKNGPH VYQDLLLSL GTTNSTLPP PFSLQSGIL | IL7R with L6 elbows with CPT trans- membrane T-ALL mutation insertion and S185C B-ALL mutation |

TABLE 19-continued

Sequences or Constitutively Expressing IL-7R

| CD8a Leader | CD19 V_L | Linker | CD19 V_H | CD8a Hinge | CD28tm | CD28 Co-stim | CD3z | 2a | Truncated CD34 | Truncated IL-7R ECD | IL-7 TMD | Trucated IL-7R ICD | Description |
|---|---|---|---|---|---|---|---|---|---|---|---|---|---|
| | | | | | | | | | IKCSGIREV KLTQGICLE QNKTSSCAE FKKDRGEGL ARVLCGEEQ ADADAGAQV CSLLIAQSE VRPQCLLLV LANRTEISS KLQLMKKHQ SDLKKLG (SEQ ID NO: 3039) | | | TLNPVAQGQ PILTSLGSN QEEAYVTMS SFYQNQ (SEQ ID NO: 3047) | |
| MALPVT ALLLPL ALLLHA ARP (SEQ ID NO: 1) | DIQMTQT SSLSASLG DRVTISCR ASQDISKY LNWYQQKP DGTVKLLI YHTSRLHS GVPSRFSG SGSGTDYS LTISNLEQ QGNTLPYT FGGGTKLE ITRADAAP TVSIFPPS SN (SEQ ID NO: 3033) | GGGGS_4 (SEQ ID NO: 9) | EVKLQESGP GLVAPSQSL SVTCTVSGV SLPDYGVSW IRQPPRKGL EMLGVIWGS ETTYYNSAL KSRLKSRLT IIKDNSKSQ VFLKMNSLQ TDDTAIYYC AKHYYYGGS YAMDYWGQG TSVTVSS (SEQ ID NO: 3034) | TTTPAPRPP TPAPTIASQ PLSLRPEAC RPAAGGAVH TRGLDFACD (SEQ ID NO: 3035) | FWLVVVG GVLACYSL LVTVAFII FWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGGK PRRKNPQE GLYNELQK DKMAEAYS EIGMKGER RRGKGHDG LYQGLSTA TKDTYDAL HMQALPPR (SEQ ID NO: 3038) | GSGATNFS LLKQAGDV EENPGP (SEQ ID NO: 3031) | MPRGWTALC LLSLLPSGF MSLDNNGTA TPELPTQGT FSNVSTNVS YQETTTPST LGSTSLHPV SQHGNEATT NITETTVKF TSTSVITSV YGNTNSSVQ SQTSVISTV FTTPANVST PETTLKPSL LPSNVSDLS TTSTSLATS PTKPYTSSS PILSDIKAE IKCSGIREV KLTQGICLE QNKTSSCAE FKKDRGEGL ARVLCGEEQ ADADAGAQV CSLLIAQSE VRPQCLLLV LANRTEISS KLQLMKKHQ SDLKKLG (SEQ ID NO: 3039) | VNLSCTKLT LLQTKLQPA AMYEIKVRS IPDHYFKGF WSEWSPSYY FRTPEINNS SGEMDPI (SEQ ID NO: 3043) | LLTISILSF PSVALLVIL ACVLW (SEQ ID NO: 3046) | KKRIKPIVW PSLPDHKKT LEHLCKKPR KNLNVSFNP ESFLDCQIH RVDDIQARD EVEGFLQDT FPQQLEESE KQRLGGDVQ SPNCPSEDV VITPESFGR DSSLTCLAG NVSACDAPI LSSSRSLDC RESGKNGPH VYQDLLLSL GTTNSTLPP PFSLQSGIL TLNPVAQGQ PILTSLGSN QEEAYVTMS SFYQNQ (SEQ ID NO: 3047) | IL7R with L6 elbows with S185C B-ALL mutation only |

TABLE 19-continued

Sequences or Constitutively Expressing IL-7R

| CD8a Leader | CD19 V_L | Linker | CD19 V_H | CD8a Hinge | CD28tm | CD28 Co-stim | CD3z | 2a | Truncated CD34 | Truncated IL-7R ECD | IL-7 TMD | Trucated IL-7R ICD | Description |
|---|---|---|---|---|---|---|---|---|---|---|---|---|---|
| MALPVT ALLLPL ALLLHA ARP (SEQ ID NO: 1) | DIQMTQT SSLSASLG DRVTISCR ASQDISKY LNWYQQKP DGTVKLLI YHTSRLHS GVPSRFSG SGSGTDYS LTISNLEQ QGNTLPYT FGGGTKLE ITRADAAP TVSIFPPS SN (SEQ ID NO: 3033) | GGGGS₄ (SEQ ID NO: 9) | EVKLQESGP GLVAPSQSL SVTCTVSGV SLPDYGVSW IRQPPRKGL EWLGVIWGS ETTYYNSAL KSRLKSRLT IIKDNSKSQ VFLKMNSLQ TDDTAIYYC AKHYYYGGS YAMDYWGQG TSVTVSS (SEQ ID NO: 3034) | TTTPAPRPP TPAPTIASQ PLSLRPEAC RPAAGGAVH TRGLDFACD (SEQ ID NO: 3035) | FWVLVVVG GVLACYSL LVTVAFII FWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGGK PRRKNPQE GLYNELQK DKMAEAYS EIGMKGER RRGKGHDG LYQGLSTA TKDTYDAL HMQALPPR (SEQ ID NO: 3038) | GSGATNFS LLKQAGDV EENPGP (SEQ ID NO: 3031) | MPRGWTALC LLSLLPSGF MSLDNNGTA TPELPTQGT FSNVSTNVS YQETTTPST LGSTSLHPV SQHGNEATT NITETTVKF TSTSVITSV YGNTNSSVQ SQTSVISTV FTTPANVST PETTLKPSL LPSNVSDLS TTSTSLATS PTKPYTSSS PILSDIKAE IKCSGIREV KLTQGICLE QNKTSSCAE FKKDRGEGL ARVLCGEEQ ADADAGAQV CSLLIAQSE VRPQCLLLV LANRTEISS KLQLMKKHQ SDLKKLG (SEQ ID NO: 3039) | VNLSSTKLT LLQRKLQPA AMYEIKVRS IPDHYFKGF WSEWSPSYY FRTPEINNS SGEMDPI (SEQ ID NO: 3042) | LLTISILSF FSVALLVIL ACVLW (SEQ ID NO: 3046) | KKRIKPIVW PSLPDHKKT LEHLCKKPR KNLNVSFNP ESFLDCQIH RVDDIQARD EVEGFLQDT FPQQLEESE KQRLGGDVQ SPNCPSEDV VITPESFGR DSSLTCLAG NVSACDAPI LSSSRSLDC RESGKNGPH VYQDLLLSL GTTNSTLPP PFSLQSGIL TLNPVAQGQ PILTSLGSN QEEAYVTMS SFYQNQ (SEQ ID NO: 3047) | Trucated IL-7R with L6 elbows WT |
| MALPVT ALLLPL ALLLHA ARP (SEQ ID NO: 1) | DIQMTQT SSLSASLG DRVTISCR ASQDISKY LNWYQQKP DGTVKLLI YHTSRLHS GVPSRFSG SGSGTDYS LTISNLEQ | GGGGS₄ (SEQ ID NO: 9) | EVKLQESGP GLVAPSQSL SVTCTVSGV SLPDYGVSW IRQPPRKGL EWLGVIWGS ETTYYNSAL KSRLKSRLT IIKDNSKSQ VFLKMNSLQ | TTTPAPRPP TPAPTIASQ PLSLRPEAC RPAAGGAVH TRGLDFACD (SEQ ID NO: 3035) | FWVLVVVG GVLACYSL LVTVAFII FWV (SEQ ID NO: 3036) | RSKRSRLLH SDYMNMTPR RPGPTRKHY QPYAPPRDF AAYRS (SEQ ID NO: 3037) | RVKFSRSA DAPAYKQG QNQLYNEL NLGRREEY DVLDKRRG RDPEMGGK PRRKNPQE GLYNELQK DKMAEAYS EIGMKGER | GSGATNFS LLKQAGDV EENPGP (SEQ ID NO: 3031) | MPRGWTALC LLSLLPSGF MSLDNNGTA TPELPTQGT FSNVSTNVS YQETTTPST LGSTSLHPV SQHGNEATT NITETTVKF TSTSVITSV | PEINNSSGE MDPI (SEQ ID NO: 3044) | LLTCPTISI LSFFSVALL VILACVLW (SEQ ID NO: 3045) | KKRIKPIVW PSLPDHKKT LEHLCKKPR KNLNVSFNP ESFLDCQIH RVDDIQARD EVEGFLQDT FPQQLEESE KQRLGGDVQ SPNCPSEDV | Trucated IL-7R with CPT T-ALL mutation. Lacking elbows and WSEWS motif (sugar bridge) (SEQ ID NO: 3070) |

TABLE 19-continued

Sequences or Constitutively Expressing IL-7R

| CD8a Leader | CD19 V_L | Linker | CD19 V_H | CD8a Hinge | CD28tm | CD28 Co-stim | CD3z | 2a | Truncated CD34 | Truncated IL-7R ECD | IL-7 TMD | Trucated IL-7R ICD | Description |
|---|---|---|---|---|---|---|---|---|---|---|---|---|---|
| | QGNTLPYT FGGGTKLE ITRADAAP TVSIFPPS SN (SEQ ID NO: 3033) | | TDDTAIYYC AKHYYYGGS YAMDYWGQG TSVTVSS (SEQ ID NO: 3034) | | | | RRGKGHDG LYQGLSTA TKDTYDAL HMQALPPR (SEQ ID NO: 3038) | | YGNTNSSVQ SQTSVLSTV FTTPANVST PETTLKPSL LPSNVSDLS TTSTSLATS PTKPYTSSS PILSDIKAE IKCSGIREV KLTQGICLE QNKTSSCAE FKKDRGEGL ARVLCGEEQ ADADAGAQV CSLLLAQSE VRPQCLLLV LANRTEISS KLQLMKKHQ SDLKKLG (SEQ ID NO: 3039) | | VITPESFGR DSSLTCLAG NVSACDAPI LSSSRSLDC RESGKNGPH VYQDLLLSL GTTNSTLPP PFSLQSGIL TLNPVAQGQ PILTSLGSN QEEAYVTMS SFYQNQ (SEQ ID NO: 3047) | |

Protocol-Nucleofection Using Nucleofector 4D:

Perform nucleofection protocol as described above (Example 6), using 20 μg of each gRNA (gGM-CSF and gCD38) to each tube of 15 μg Cas9 mRNA.

Step 4: Assessment of CRISPR Activity and Td Efficiency (Day 10)

Take $5\times10^5$ cells from each sample and analyze by flow cytometry. Wash samples with RB. Add 5 μl of CD3 APC and 2 μl of anti-FAB BV421 (detects CAR transduction). Wash. Perform Flow cytometry. Cells should be CD38-negative, CD34-positive and FAB+. Harvest T cells (Day 11).

Purification of CAR-T cells. TCR negative cells can be purified using TCRa/b negative selection to remove TCR positive cells.

Step 5: Assessment of CAR-T Activity In Vivo

Inject $5\times10^6$ CAR-T per mouse I.V. Assess serum cytokine levels (Day+1, +2, +3 +4, +5, +10, +15). Measure serum cytokine levels using Luminex multiplex cytokine profiling assay to check for elevations in CRS related cytokines. Perform a 4-hr chromium release assay against targets cells (Raji) to assess in vitro activity (Day 11). Monitor efficacy of tumor clearance using flow cytometry of blood to detect hCD45, CD19+ cells.

A modified gRNA protocol for T cell CRISPR and CAR-T transduction of UCART19 is provided below.

Day 0-T Cell Activation:

Purify T cells from a leukapheresis chamber using a Miltenyi human PanT isolation kit. Resuspend in media. Count cells. Determine the number of human T cell activation CD3/CD28 beads required to obtain a 3:1 bead: cell ratio. Wash beads 2× with T cell media. Dilute cells at 1.256 cells/mL in hXcyte media. Add human T cell activation CD3/CD28 beads T cells may then be transduced with one or more CARs targeted to (i.e., that recognizes) one or more targets, for example with a lentivirus containing a CAR construct. Any other suitable method of transduction may be used.

Day 2: $4\times10^6$ cells per reaction are used. EO-115-100 μl transfection volume is programmed, and the entire supplement added to the Nucleofector™ Solution P3. Cell culture plates are prepared by filling appropriate number of wells with desired volume of recommended culture media (2 ml in 6 well plate) and pre-incubating/equilibrating plates in a humidified 37° C./5% $CO_2$ incubator. Beads are magnetically removed (twice to ensure complete removal), then cells counted and cell density determined. The required number of cells are centrifuged at 90×g for 10 minutes at room temperature, the supernatant removed completely. Cells are then resuspended in PBS (1 ml) and transferred to a microcentrifuge tube, and the required number of cells centrifuged at 90×g for 10 minutes at room temperature. The supernatant is removed completely, and the cell pellet resuspended carefully in complete room temperature 4D Nucleofector™ Solution P3, $4\times10^6$ per 100 μl). Twenty μg of gRNA (gGM-CSF and gTRAC) are added to each tube of 15 μg Cas9 mRNA. Then 100 μl of cells is added to each tube of Cas9/gRNA, gently mixed and everything transferred into the Nucleocuvette™. The cuvette is gently tapped to remove bubbles. Electroporation is carried out using program (Human T cell stim EO-115). After run completion, the Nucleocuvette™ is carefully removed from the vessel from the retainer using a specialized tool. Cells are resuspended with pre-warmed medium. The media is then taken up from destination well, added to cuvette, and gently pipetted up and down two to three times. This is then transferred to well. This procedure is repeated with media from same well and incubated at 37° C.

Day 5: Assessment of CRISPR activity and Td efficiency. Samples of cells may then be assessed for transduction efficiency by taking a $5\times10^5$ cells from each sample and analyzing by flow cytometry. Samples are fix permeablised and anlaysed by FACS for CD3, CD34 and intracellular GM-CSF.

Assessment of Genetic Deletion.

To assess genetic deletion of GM-CSF and TRAC, $5\times10^5$ cells are harvested from each sample and their DNA extracted. Gene editing efficiency is assessed using target sequencing of the target loci using TIDE-analysis or deep sequencing.

Day 11

Bleed mice and measure tumor burden.

CD3 deplete T cells and inject into mice.

Inject mice with $5\times10^6$ CAR+ T cells/mouse.

Mouse groups are provided in Table 20 below:

TABLE 20

| Sample ID | Gene editing | Tumor | T cell source | CAR-T | CAR-T |
|---|---|---|---|---|---|
| A | — | $2\times10^6$/mouse | — | — | — |
| B | TRAC | $2\times10^6$/mouse | PanT | CAR19 + CD34 | $5\times10^6$/mouse |
| C | TRAC + GM-CSF | $2\times10^6$/mouse | PanT | CAR 19 CD34 | $5\times10^6$/mouse |
| D | TRAC | $2\times10^6$/mouse | PanT | CAR 19 + IL7r + CD34 | $5\times10^6$/mouse |
| E | TRAC + GM-CSF | $2\times10^6$/mouse | PanT | CAR 19 + IL7r + CD34 | $5\times10^6$/mouse |

Attune - CAR-T in vivo panel - CRS

| Detector | Bandpass (nm) | Antigen | Colour | Product # | Titer 50 μl blood or 500K in 100 μl |
|---|---|---|---|---|---|
| BL1 | 530/30 | | | | |
| BL2 | 695/40 | 7aad | 7AAd | | 1 ul |
| RL1 | 670/14 | CD19 | APC | BD555415 | 2 ul |
| RL2 | 720/30 | | | | |
| RL3 | 780/60 | CD4 | APC-H7 | BD560158 | 1 ul |
| VL1 | 450/40 | mCD45 | BV421 | BD563890 | 1 ul |
| VL2 | 525/50 | CD8 | BV510 | BD563256 | 4 ul |
| VL3 | 610/20 | | | | |
| VL4 | 660/20 | CD3 | BV650 | BD563852 | 2 ul |
| VL5 | 710/50 | | | | |
| VL6 | 780/60 | hCD45 | BV785 | BD563716 | 1 ul |
| YL1 | 585/16 | CD34 | PE | BD Pool PE | 2 ul |
| YL2 | 620/15 | | | | |
| YL3 | 780/60 | | | | |

Cytokine analysis and assessment of CRS is assed using Millipore luminex multiplex cytokine analysis.

Sequences for preparation of a vector as described herein include, but are not limited to, the following:

```
Left ITR of vector for insertion of CD34 into GM-CSF locus
                                                      SEQ ID NO: 3048
CCTGCAGGCAGCTGCGCGCTCGCTCGCTCACTGAGGCCGCCCGGGCGTCGGGCGACCTTTGGTCGCCCGGCCTCAGTGAGCGAGCGAGC

GCGCAGAGAGGGAGTGGCCAACTCCATCACTAGGGGTTCCT

Left Homology Arm of vector for insertion of CD34 into GM-CSF locus
                                                      SEQ ID NO: 3049
cctgagatggatgcagccacagccctggagccagcctgaagctcctggtgtcttctgggggctacatataggagtgtagtccgaacctc agaggggcaaacctgctctgcagagggaatcaaggttcacataaccagagaggggagtcactcaggaaggtggctccagagccaagagt cagactctgggtcccgacttgacccagccacaccccctctgaagcttgctgagagtggctgcagtctcgctgctggatgtgcacatggt ggtcattccctctgctcacaggggcaggggtccccccttactggactgaggttgcccctgctccaggtcctgggtgggagcccatgtg aactgtcagtggggcaggtctgtgagagctcccctcacactcaagtctctcacagtggccagagaagaggaaggctggagtcagaatga ggcaccagggcgggcatagcctgcccaaaggccctgggattacaggcaggatggggagccctatctaagtgtctcccacgcccaccc cagccattccaggccaggaagtccaaactgtgcccctcagagggaggggcagcctcaggcccattcagactgcccagggagggctgga gagccctcaggaaggcgggtgggtgggctgtcggttcttggaaaggttcattaatgaaaaccccaagcctgaccacctagggaaaagg ctcaccgttcccatgtgtggctgataaggggccaggagattccacagttcaggtagttccccgcctccctggcatttgtggtcaccat taatcatttcctctgtgtatttaagagctcttttgccagtgagcccaGTACACAGAGAGAAAGGCTAAAGTTCTCTGGAGGATGTGGCT GCAGAGCCTGCTGCTCTTGGGCACTGTGGCCTGCAGCATCTCTGCACCCGCCCGCTCGCCCAGCCCCAGCACGCAGCCCTGGGAGCATG

TGAATGCCATCCAGGAGGCCC

EFS promotor of vector for insertion of CD34 into GM-CSF locus
                                                      SEQ ID NO: 3050
GGCTCCGGTGCCCGTCAGTGGGCAGAGCGCACATCGCCCACAGTCCCCGAGAAGTTGGGGGGAGGGGTCGGCAATTGATCCGGTGCCTA GAGAAGGTGGCGCGGGGTAAACTGGGAAAGTGATGTCGTGTACTGGCTCCGCCTTTTTCCCGAGGGTGGGGGAGAACCGTATATAAGTG

CAGTAGTCGCCGTGAACGTTCTTTTTCGCAACGGGTTTGCCGCCAGAACACAGG trCD34 of vector for insertion of CD34 into GM-CSF locus
                                                      SEQ ID NO: 3051
atgccgcggggctggaccgcgctttgcttgctgagtttgctgcctttctgggttcatgagtcttgacaacaacggtactgctaccccaga gttacctacccagggaacattttcaaatgtttctacaaatgtatcctaccaagaaactacaacacctagtacccttggaagtaccagcc tgcacctgtgtctcaacatggcaatgaggccacaacaaacatcacagaaacgacagtcaaattcacatctacctctgtgataacctca gtttatggaaacacaaactcttctgtccagtcacagacctctgtaatcagcacagtgttcaccaccccagccaacgtttcaactccaga gacaaccttgaagcctagcctgtcacctggaaatgtttcagaccctttcaaccactagcactagccttgcaacatctcccactaaaccct atacatcatcttctcctatcctaagtgacatcaaggcagaaatcaaatgttcaggcatcagagaagtgaaattgactcagggcatctgc ctggagcaaaataagacctccagctgtgcggagtttaagaaggacaggggagagggcctggcccgagtgctgtgtggggaggagcaggc tgatgctgatgctggggcccaggtatgctccctgctccttgcccagtctgaggtgaggcctcagtgtctactgctggtcttggccaaca gaacagaaatttccagcaaactccaacttatgaaaaagcaccaatctgacctgaaaaagctggggatcctagatttcactgagcaagat gttgcaagccaccagagctattcccaaaagaccctgattgcactggtcacctcgggagccctgctggctgtcttgggcatcactggcta tttcctgatgaatcgccgcagctggagccccatttaa hGMB Poly A of vector for insertion of CD34 into GM-CSF locus
                                                      SEQ ID NO: 3052
ACGGGTGGCATCCCTGTGACCCCTCCCCAGTGCCTCTCCTGGCCCTGGAAGTTGCCACTCCAGTGCCCACCAGCCTTGTCCTAATAAAA TTAAGTTGCATCATTTTGTCTGACTAGGTGTCCTTCTATAATATTATGGGGTGGAGGGGGGTGGTATGGAGCAAGGGGCAAGTTGGGAA GACAACCTGTAGGGCCTGCGGGGTCTATTGGGAACCAAGCTGGAGTGCAGTGGCACAATCTTGGCTCACTGCAATCTCCGCCTCCTGGG TTCAAGCGATTCTCCTGCCTCAGCCTCCCGAGTTGTTGGGATTCCAGGCATGCATGACCAGGCTCAGCTAATTTTTGTTTTTTGGTAG AGACGGGGTTTCACCATATTGGCCAGGCTGGTCTCCAACTCCTAATCTCAGGTGATCTACCCACCTTGGCCTCCCAAATTGCTGGGATT

ACAGGCGTGAACCACTGCTCCCTTCCCTGTCCTTCTGATTTTGTAGGTAACCACGTGCGGACCGA
```

RHA of vector for insertion of CD34 into GM-CSF locus

SEQ ID NO: 3053

CGTCTCCTGAACCTGAGTAGAGACACTGCTGCTGAGATGgtaagtgagagaatgtgggcctgtgcctaggccacccagctggccctga ctggccacgcctgtcagcttgataacatgacattttccttttctacagAATGAAACAGTAGAAGTCATCTCAGAAATGTTTGACCTCCA Ggtaagatgcttctctctgacatagctttccagaagcccctgccctggggtggaggtggggactccattttagatggcaccacacaggg ttgtccactttctctccagtcagctggctgcaggaggaggggtagcaactgggtgctcaagaggctgctggccgtgccctatggcag tcacatgagctcctttatcagctgagcggccatgggcagacctagcattcaatggccaggagtcaccaggggacaggtggtaaagtggg ggtcacttcatgagacaggagctgtgggtttggggcgctcactgtgccccgagaccaagtcctgttgagacagtgctgactacagagag gcacagagggtttcaggaacaacccttgcccacccagcaggtccaggtgaggccccacccccctctccctgaatgatgggtgagagt cacctccttccctaaggctgggctcctctccaggtgccgctgagggtggcctgggcggggcagtgagaagggcaggttcgtgcctgcca tggacagggcagggtctatgactggacccagcctgtgcccctcccaagccctactcctgggggctgggggcagcagcaaaaaggagtgg tggagagttcttgtaccactgtgggcacttggccactgctcaccgacgaacgacattttccacagGAGCCGACCTGCCTACAGACCCGC CTGGAGCTGTACAAGCAGGGCCTGCGGGGCAGCCTCACCAAGCTCAAGGGCCCCTTGACCATGATGGCCAGCCACTACAAGCAGCACTG CCCTCCAACCCCGgtgagtgc Right ITR of vector for insertion of CD34 into GM-CSF locus

SEQ ID NO: 51

AGGAACCCCTAGTGATGGAGTTGGCCACTCCCTCTCTGCGCGCTCGCTCGCTCACTGAGGCCGGGCGACCAAAGGTCGCCCGACGCCCG

GGCTTTGCCCGGGCGGCCTCAGTGAGCGAGCGAGCGCGCAGCTGCCTGCAGG

Complete sequence of vector for insertion of CD34 into GM-CSF locus

SEQ ID NO: 3054

CCTGCAGGCAGCTGCGCGCTCGCTCGCTCACTGAGGCCGCCCGGGCGTCGGGCGACCTTTGGTCGCCCGGCCTCAGTGAGCGAGCGAGC

GCGCAGAGAGGGAGTGGCCAACTCCATCACTAGGGGTTCCTcctgagatggatgcagccacagccctggagccagcctgaagctcctgg tgtcttctgggggctacatataggagtgtagtccgaacctcagaggggcaaacctgctctgcagagggaatcaaggttcacataaccag agaggggagtcactcaggaaggtggctccagagccaagagtcagactctgggtcccgacttgacccagccacacccctctgaagcttg ctgagagtggctgcagtctcgctgctggatgtgcacatggtggtcattccctctgctcacaggggcagggtcccccttactggactg aggttgcccctgctccaggtcctgggtgggagcccatgtgaactgtcagtgggcaggtctgtgagagctcccctcacactcaagtct ctcacagtggccagagaagaggaaggctggagtcagaatgaggcaccagggcgggcatagcctgcccaaaggcccctgggattacaggc aggatggggagccctatctaagtgtctcccacgccccaccccagccattccaggccaggaagtccaaactgtgcccctcagagggaggg ggcagcctcaggcccattcagactgcccagggagggctggagagccctcaggaaggcgggtgggtgggctgtcggttcttggaaaggtt cattaatgaaaaccccaagcctgaccacctagggaaaaggctcaccgttcccatgtgtggctgataagggccaggagattccacagtt caggtagttcccccgcctccctggcattttgtggtcaccattaatcatttcctctgtgtatttaagagctcttttgccagtgagcccaG TACACAGAGAGAAAGGCTAAAGTTCTCTGGAGGATGTGGCTGCAGAGCCTGCTGCTCTTGGGCACTGTGGCCTGCAGCATCTCTGCACC CGCCCGCTCGCCCAGCCCCAGCACGCAGCCCTGGGAGCATGTGAATGCCATCCAGGAGGCCCGGCTCCGGTGCCCGTCAGTGGGCAGAG CGCACATCGCCCACAGTCCCCGAGAAGTTGGGGGGAGGGGTCGGCAATTGATCCGGTGCCTAGAGAAGGTGGCGCGGGGTAAACTGGGA AAGTGATGTCGTGTACTGGCTCCGCCTTTTTCCCGAGGGTGGGGGAGAACCGTATATAAGTGCAGTAGTCGCCGTGAACGTTCTTTTTC GCAACGGGTTTGCCGCCAGAACACAGGatgccgcggggctggaccgcgctttgcttgctgagtttgctgccttctgggttcatgagtct tgacaacaacggtactgctaccccagagttacctacccagggaacattttcaaatgtttctacaaatgtatcctaccaagaaactacaa cacctagtaccccttggaagtaccagcctgcaccctgtgtctcaacatggcaatgaggccacaacaaacatcacagaaacgacagtcaaa ttcacatctacctctgtgataacctcagtttatgaaacacaaactcttctgtccagtcacagacctctgtaatcagcacagtgttcac caccccagccaacgtttcaactccagagacaaccttgaagcctagcctgtcacctggaaatgtttcagacctttcaaccactagcacta gccttgcaacatctcccactaaaccctatacatcatcttctcctatcctaagtgacatcaaggcagaaatcaaatgttcaggcatcaga gaagtgaaattgactcagggcatctgcctggagcaaaataagacctccagctgtgcggagtttaagaaggacaggggagagggcctggc ccgagtgctgtgtgggaggagcaggctgatgctgatgctggggcccaggtatgctccctgctccttgcccagtctgaggtgaggcctc agtgtctactgctggtcttggccaacagaacagaaatttccagcaaactccaacttatgaaaaagcaccaatctgacctgaaaaagctg -continued

```
gggatcctagatttcactgagcaagatgttgcaagccaccagagctattcccaaaagaccctgattgcactggtcacctcgggagccct gctggctgtcttgggcatcactggctattcctgatgaatcgccgcagctggagccccatttaaACGGGTGGCATCCCTGTGACCCCTC CCCAGTGCCTCTCCTGGCCCTGGAAGTTGCCACTCCAGTGCCCACCAGCCTTGTCCTAATAAAATTAAGTTGCATCATTTTGTCTGACT AGGTGTCCTTCTATAATATTATGGGGTGGAGGGGGGTGGTATGGAGCAAGGGGCAAGTTGGGAAGACAACCTGTAGGGCCTGCGGGGTC TATTGGGAACCAAGCTGGAGTGCAGTGGCACAATCTTGGCTCACTGCAATCTCCGCCTCCTGGGTTCAAGCGATTCTCCTGCCTCAGCC TCCCGAGTTGTTGGGATTCCAGGCATGCATGACCAGGCTCAGCTAATTTTTGTTTTTTTGGTAGAGACGGGGTTTCACCATATTGGCCA GGCTGGTCTCCAACTCCTAATCTCAGGTGATCTACCCACCTTGGCCTCCCAAATTGCTGGGATTACAGGCGTGAACCACTGCTCCCTTC CCTGTCCTTCTGATTTTGTAGGTAACCACGTGCGGACCGACGTCTCCTGAACCTGAGTAGAGACACTGCTGCTGAGATGgtaagtgaga gaatgtgggcctgtgcctaggccacccagctggcccctgactggccacgcctgtcagcttgataacatgacattttccttttctacagA ATGAAACAGTAGAAGTCATCTCAGAAATGTTTGACCTCCAGgtaagatgcttctctctgacatagctttccagaagcccctgccctggg gtggaggtggggactccatttttagatggcaccacacaggggttgtccactttctctccagtcagctggctgcaggaggagggggtagcaa ctgggtgctcaagaggctgctggccgtgcccctatggcagtcacatgagctcctttatcagctgagcggccatgggcagacctagcatt caatggccaggagtcaccaggggacaggtggtaaagtgggggtcacttcatgagacaggagctgtgggtttggggcgctcactgtgccc cgagaccaagtcctgttgagacagtgctgactacagagaggcacagaggggtttcaggaacaaccttgcccacccagcaggtccaggt gaggccccaccccctctccctgaatgatggggtgagagtcacctccttccctaaggctgggctcctctccaggtgccgctgagggtgg cctgggcggggcagtgagaagggcaggttcgtgcctgccatggacagggcagggtctatgactggacccagcctgtgcccctcccaagc cctactcctgggggctgggggcagcagcaaaaaggagtggtggagagttcttgtaccactgtgggcacttggccactgctcaccgacga acgacattttccacagGAGCCGACCTGCCTACAGACCCGCCTGGAGCTGTACAAGCAGGGCCTGCGGGGCAGCCTCACCAAGCTCAAGG GCCCCTTGACCATGATGGCCAGCCACTACAAGCAGCACTGCCCTCCAACCCCGgtgagtgcAGGAACCCCTAGTGATGGAGTTGGCCAC TCCCTCTCTGCGCGCTCGCTCGCTCACTGAGGCCGGGCGACCAAAGGTCGCCCGACGCCCGGGCTTTGCCCGGGCGGCCTCAGTGAGCG

AGCGAGCGCGCAGCTGCCTGCAGG
``` left ITR of donor construct for inserting GFP into CD3ε locus

SEQ ID NO: 3048

```
CCTGCAGGCAGCTGCGCGCTCGCTCGCTCACTGAGGCCGCCCGGGCGTCGGGCGACCTTTGGTCGCCCGGCCTCAGTGAGCGAGCGAGC

GCGCAGAGAGGGAGTGGCCAACTCCATCACTAGGGGTTCCT
``` cloning remnants of donor construct for inserting GFP into CD3ε locus

SEQ ID NO: 3055

```
GCGGCCGCATCGATTGaattc
```

CD3 L homology arm of donor construct for inserting GFP into CD3ε locus

SEQ ID NO: 3056

```
AGGTAAGTCCACGAATCAGTGATTCAGTGGTGTGGAGAGCTTTATTTCTGAGAAGGCCAGTAGCGCTCCCTTCTGACAAGCAAATCTAA

GACCTGGATGACAGATGACTTCCTGCATTTGGTTGGTTCTTTTGTCATTCATATCTATCTGTAATACAGTTCTGGCTAATTTAAGAGGA

TAAGCTTGAAGACCTCTGGAATTTTTCGGCTTTAGGACTTTAAGGCTTTCTGAGCTTCAGTAGATCTAGATCTAGGAGCTCATGCTGGT

ATATTCTGAATCCGATGTATCTGAGTTACATCTATGAGCTACTTAATAAATATATCTATGAGCTAAATCTCATAGGCTAAGCATGAACC

TCACCTCCAAGACTCGGGGTTCCTAAATGGATGAGACCCTCTTTGGGAAGTCTTGTGGGCAGTGTCTAATTCCACTAGAAAAGTTTTAC

CTACAATTTAAACTTAAACCATGATATTTTCTTACTGCTGTTTCCTTTTTTCATTTTCAGGTGGTATTACACAGACACGTGAGTTTATT

GGTCTTTTATTTATGCCCTGTCTGAGGATGCAGATTGGTGGGTAGATGAGAAGGAACTGATTGAGAGAGATTAACCCCAAGAACTGATA

TCTTCCCAGCATTGCATTCTCAACTCCATTTTAGAAAGGTTCCAAATAGGGACTTCTGTGGGTTTTTCTTTACATCCATCTTACCCTTC

CCAAGTCCCCATGTCCCTGCGTAAACCCTAAAGCCACCTCTCAAAAGGTTCTCTAGTTCCCTTCAAGGTTCTCTAGTTCCCTTCATTCC

ACATATCTCCTCTTCCACACCCTCTAGCCAGTAGAGCTCCCTTCTGACAAGCAAGTCTAAGATCTAGATGACAGATGACTTCCTGCATT

TGGGTGGTTCTTTTGTCACTAATTTGCCTTTTCTAAAATTGTCCTGGTTTCTTCTGCCAATTTCCCTTCTTTCTCCCCAGCATATAAAG

TCTCCATCTCTGGAACCACA
```

CAR7 of donor construct for inserting GFP into CD3ε locus

SEQ ID NO: 3057 atggccttaccagtgaccgccttgctcctgccgctggccttgctgctccacgccgccaggccggatatccagatgacacagactacatc ctccctgtctgcctctctgggagacagagtcaccatcagttgcagtgcaagtcagggcattagcaattatttaaactggtatcagcaga aaccagatggaactgttaaactcctgatctattacacatcaagtttacactcaggagtcccatcaaggttcagtggcagtgggtctggg acagattattctctcaccatcagcaacctggaacctgaagatattgccacttattattgtcagcagtatagcaagcttccgtacacgtt cggaggggggaccaagctggaaataaaaacgtggtggtggtggttctggtggtggtggttctggcggcggcggctccggtggtggtggat ccgaggtgcaactggtggagtctgggggaggcttagtgaagcctggggggtccctgaaactctcctgtgcagcctctggactcactttc agtagctatgccatgtcttgggttcgccagactccagagaagaggctggagtgggtcgcatccattagtagtggtggtttcacctacta tccagacagtgtgaagggccgattcaccatctccagagataatgccaggaacatcctgtatctgcaaatgagcagtctgaggtctgagg acacggccatgtattactgtgcaagagacgaggtacgggggtacctcgatgtctggggcgcagggaccacggtcaccgtttccctagg GCTAGCaccacgacgccagcgccgcgaccaccaacaccggcgcccaccatcgcgtcgcagcccctgtccctgcgcccagaggcgtgccg gccagcggcgggggcgcagtgcacacgaggggctggacttcgcctgtgatttttgggtgctggtggtggttggtggagtcctggctt gctatagcttgctagtaacagtggcctttattattttctgggtgaggagtaagaggagcaggctcctgcacagtgactacatgaacatg actcccgcgccccgggcccaccogcaagcattaccagccctatgcccaccacgcgacttcgcagcctatcgctccagagtgaagtt cagcaggagcgcagacgcccccgcgtacaagcagggccagaaccagctctataacgagctcaatctaggacgaagagaggagtacgatg ttttggacaagagacgtggccgggaccctgagatgggggaaagccgagaaggaagaaccctcaggaaggcctgtacaatgaactgcag aaagataagatggcggaggcctacagtgagattgggatgaaaggcgagcgccggaggggcaaggggcacgatggcctttaccagggtct cagtacagccaccaaggacacctacgacgcccttcacatgcaggccctgccccctcgcCGGACCGATggaagcggagctactaacttca gcctgctgaagcaggctggagacgtggaggagaaccctggacctgtttctgaagccatgccgcggggctggaccgcgctttgcttgctg agtttgctgccttctgggttcatgagtcttgacaacaacggtactgctaccccagagttacctacccagggaacattttcaaatgtttc tacaaatgtatcctaccaagaaactacaacacctagtaccttggaagtaccagcctgcaccctgtgtctcaacatggcaatgaggcca caacaaacatcacagaaacgacagtcaaattcacatctacctctgtgataacctcagtttatggaaacacaaactcttctgtccagtca cagacctctgtaatcagcacagtgttcaccaccccagccaacgtttcaactccagagacaaccttgaagcctagcctgtcacctggaaa tgtttcagacctttcaaccactagcactagccttgcaacatctcccactaaaccctatacatcatcttctcctatcctaagtgacatca aggcagaaatcaaatgttcaggcatcagagaagtgaaattgactcagggcatctgcctggagcaaaataagacctccagctgtgcggag tttaagaaggacaggggagagggcctggcccgagtgctgtgtggggaggagcaggctgatgctgatgctggggcccaggtatgctccct gctccttgcccagtctgaggtgaggcctcagtgtctactgctggtcttggccaacagaacagaaatttccagcaaactccaacttatga aaaagcaccaatctgacctgaaaaagctggggatcctagatttcactgagcaagatgttgcaagccaccagagctattcccaaaagacc ctgattgcactggtcacctcgggagccctgctggctgtcttgggcatcactggctatttcctgatgaatcgccgcagctggagcccat ttaa GFP of donor construct for inserting into CD3ε locus

SEQ ID NO: 3058

ATGGTGAGCAAGGGCGAGGAGCTGTTCACCGGGGTGGTGCCCATCCTGGTCGAGCTGGACGGCGACGTAAACGGCCACAAGTTCAGCGT

GTCCGGCGAGGGCGAGGGCGATGCCACCTACGGCAAGCTGACCCTGAAGTTCATCTGCACCACCGGCAAGCTGCCCGTGCCCTGGCCCA

CCCTCGTGACCACCCTGACCTACGGCGTGCAGTGCTTCAGCCGCTACCCCGACCACATGAAGCAGCACGACTTCTTCAAGTCCGCCATG

CCCGAAGGCTACGTCCAGGAGCGCACCATCTTCTTCAAGGACGACGGCAACTACAAGACCCGCGCCGAGGTGAAGTTCGAGGGCGACAC

CCTGGTGAACCGCATCGAGCTGAAGGGCATCGACTTCAAGGAGGACGGCAACATCCTGGGGCACAAGCTGGAGTACAACTACAACAGCC

ACAACGTCTATATCATGGCCGACAAGCAGAAGAACGGCATCAAGGTGAACTTCAAGATCCGCCACAACATCGAGGACGGCAGCGTGCAG

CTCGCCGACCACTACCAGCAGAACACCCCCATCGGCGACGGCCCCGTGCTGCTGCCCGACAACCACTACCTGAGCACCCAGTCCGCCCT

GAGCAAAGACCCCAACGAGAAGCGCGATCACATGGTCCTGCTGGAGTTCGTGACCGCCGCCGGGATCACTCTCGGCATGGACGAGCTGT

ACAAGTAA

-continued hGMB poly A of donor construct for inserting GFP into CD3ε locus
SEQ ID NO: 3059
ACGGGTGGCATCCCTGTGACCCCTCCCCAGTGCCTCTCCTGGCCCTGGAAGTTGCCACTCCAGTGCCCACCAGCCTTGTCCTAATAAAA TTAAGTTGCATCATTTTGTCTGACTAGGTGTCCTTCTATAATATTATGGGGTGGAGGGGGGTGGTATGGAGCAAGGGGCAAGTTGGGAA GACAACCTGTAGGGCCTGCGGGGTCTATTGGGAACCAAGCTGGAGTGCAGTGGCACAATCTTGGCTCACTGCAATCTCCGCCTCCTGGG TTCAAGCGATTCTCCTGCCTCAGCCTCCCGAGTTGTTGGGATTCCAGGCATGCATGACCAGGCTCAGCTAATTTTTGTTTTTTTGGTAG AGACGGGGTTTCACCATATTGGCCAGGCTGGTCTCCAACTCCTAATCTCAGGTGATCTACCCACCTTGGCCTCCCAAATTGCTGGGATT

ACAGGCGTGAACCACTGCTCCCTTCCCTGTCCTTCTGATTTTGTAGGTAACCAC

CD3ε R homology ARM of donor construct for inserting GFP into CD3ε locus
SEQ ID NO: 3060
aGTAtaatattgacatgccctcagtatcctggatctgaaatactatggcaacacaatgataaaaacataggcggtgatgaggatgataa aaacataggcagtgatgaggatcacctgtcactgaaggaattttcagaattggagcaaagtggttattatgtctgctacccagaggaa gcaaaccagaagatgcgaacttttatctctacctgagggcaagagtgtgtgagaactgcatggagatggatgtgatgtcggtggccaca attgtcatagtggacatctgcatcactgggggcttgctgctgctggtttactactggagcaagaatagaaaggccaaggccaagcctgt gacacgaggagcgggtgctggcggcaggcaaaggggacaaaacaaggagaggccaccacctgttcccaacccagactatgagcccatcc ggaaaggccagcgggacctgtattctggcctgaatcagagacgcatctgaccctctggagaacactgcctcccgctggcccaggtctcc tctccagtcccctgcgactccctgtttcctgggctagtcttggaccccacgagagagaatcgttcctcagcctcatggtgaactcgcg ccctccagcctgatccccgctccctcctccctgccttctctgctggtacccagtcctaaaatattgctgcttcctcttcctttgaagc atcatcagtagtcacaccctcacagctggcctgccctcttgccaggatatttatttgtgctattcactccctttcctttggatgtaact tctccgttcagttccctccttttcttgcatgtaagttgtcccccatcccaaagtattccatctacttttctatcgccgtccccttttgc agccctctctggggatggactgggtaaatgttgacagaggccctgccccgttcacagatcctggccctgagccagccctgtgctcctcc ctcccccaacactccctaccaacc cloning remnants of donor construct for inserting GFP into CD3ε locus
SEQ ID NO: 3061
GCGgacCGAGCGGCCGC right ITR of donor construct for inserting GFP into CD3ε locus
SEQ ID NO: 3062
AGGAACCCCTAGTGATGGAGTTGGCCACTCCCTCTCTGCGCGCTCGCTCGCTCACTGAGGCCGGGCGACCAAAGGTCGCCCGACGCCCG

GGCTTTGCCCGGGCGGCCTCAGTGAGCGAGCGAGCGCGCAGCTGCCTGCAGG cloning remnants of donor construct for inserting GFP into CD3ε locus
SEQ ID NO: 3063
CCTGCAGGCAGCTGCGCGCTCGCTCGCTCACTGAGGCCGCCCGGGCGTCGGGCGACCTTTGGTCGCCCGGCCTCAGTGAGCGAGCGAGC GCGCAGAGAGGGAGTGGCCAACTCCATCACTAGGGGTTCCTGCGGCCGCATCGATTGaattcAGGTAAGTCCACGAATCAGTGATTCAG TGGTGTGGAGAGCTTTATTTCTGAGAAGGCCAGTAGCGCTCCCTTCTGACAAGCAAATCTAAGACCTGGATGACAGATGACTTCCTGCA TTTGGTTGGTTCTTTTGTCATTCATATCTATCTGTAATACAGTTCTGGCTAATTTAAGAGGATAAGCTTGAAGACCTCTGGAATTTTTC GGCTTTAGGACTTTAAGGCTTTCTGAGCTTCAGTAGATCTAGATCTAGGAGCTCATGCTGGTATATTCTGAATCCGATGTATCTGAGTT ACATCTATGAGCTACTTAATAAATATATCTATGAGCTAAATCTCATAGGCTAAGCATGAACCTCACCTCCAAGACTCGGGGTTCCTAAA TGGATGAGACCCTCTTTGGGAAGTCTTGTGGGCAGTGTCTAATTCCACTAGAAAAGTTTTACCTACAATTTAAACTTAAACCATGATAT TTTCTTACTGCTGTTTCCTTTTTTCATTTTCAGGTGGTATTACACAGACACGTGAGTTTATTGGTCTTTTATTTATGCCCTGTCTGAGG ATGCAGATTGGTGGGTAGATGAGAAGGAACTGATGAGAGAGATTAACCCCAAGAACTGATATCTTCCCAGCATTGCATTCTCAACTCC ATTTTAGAAAGGTTCCAAATAGGGACTTCTGTGGGTTTTTCTTTACATCCATCTTACCCTTCCCAAGTCCCCATGTCCCTGCGTAAACC CTAAAGCCACCTCTCAAAAGGTTCTCTAGTTCCCTTCAAGGTTCTCTAGTTCCCTTCATTCCACATATCTCCTCTTCCACACCCTCTAG CCAGTAGAGCTCCCTTCTGACAAGCAAGTCTAAGATCTAGATGACAGATGACTTCCTGCATTTGGGTGGTTCTTTTGTCACTAATTTGC CTTTTCTAAAATTGTCCTGGTTTCTTCTGCCAATTTCCCTTCTTTCTCCCCAGCATATAAAGTCTCCATCTCTGGAACCACAATGGTGA GCAAGGGCGAGGAGCTGTTCACCGGGGTGGTGCCCATCCTGGTCGAGCTGGACGGCGACGTAAACGGCCACAAGTTCAGCGTGTCCGGC GAGGGCGAGGGCGATGCCACCTACGGCAAGCTGACCCTGAAGTTCATCTGCACCACCGGCAAGCTGCCCGTGCCCTGGCCCACCCTCGT

```
GACCACCCTGACCTACGGCGTGCAGTGCTTCAGCCGCTACCCCGACCACATGAAGCAGCACGACTTCTTCAAGTCCGCCATGCCCGAAG
GCTACGTCCAGGAGCGCACCATCTTCTTCAAGGACGACGGCAACTACAAGACCCGCGCCGAGGTGAAGTTCGAGGGCGACACCCTGGTG
AACCGCATCGAGCTGAAGGGCATCGACTTCAAGGAGGACGGCAACATCCTGGGGCACAAGCTGGAGTACAACTACAACAGCCACAACGT
CTATATCATGGCCGACAAGCAGAAGAACGGCATCAAGGTGAACTTCAAGATCCGCCACAACATCGAGGACGGCAGCGTGCAGCTCGCCG
ACCACTACCAGCAGAACACCCCCATCGGCGACGGCCCCGTGCTGCTGCCCGACAACCACTACCTGAGCACCCAGTCCGCCCTGAGCAAA
GACCCCAACGAGAAGCGCGATCACATGGTCCTGCTGGAGTTCGTGACCGCCGCCGGGATCACTCTCGGCATGGACGAGCTGTACAAGTA
AACGGGTGGCATCCCTGTGACCCCTCCCCAGTGCCTCTCCTGGCCCTGGAAGTTGCCACTCCAGTGCCCACCAGCCTTGTCCTAATAAA
ATTAAGTTGCATCATTTTGTCTGACTAGGTGTCCTTCTATAATATTATGGGGTGGAGGGGGGTGGTATGGAGCAAGGGGCAAGTTGGGA
AGACAACCTGTAGGGCCTGCGGGGTCTATTGGGAACCAAGCTGGAGTGCAGTGGCACAATCTTGGCTCACTGCAATCTCCGCCTCCTGG
GTTCAAGCGATTCTCCTGCCTCAGCCTCCCGAGTTGTTGGGATTCCAGGCATGCATGACCAGGCTCAGCTAATTTTTGTTTTTTTGGTA
GAGACGGGGTTTCACCATATTGGCCAGGCTGGTCTCCAACTCCTAATCTCAGGTGATCTACCCACCTTGGCCTCCCAAATTGCTGGGAT
TACAGGCGTGAACCACTGCTCCCTTCCCTGTCCTTCTGATTTTGTAGGTAACCACaGTAtaatattgacatgccctcagtatcctggat
ctgaaatactatggcaacacaatgataaaaacataggcggtgatgaggatgataaaaacataggcagtgatgaggatcacctgtcactg
aaggaattttcagaattggagcaaagtggttattatgtctgctaccccagaggaagcaaaccagaagatgcgaacttttatctctacct
gagggcaagagtgtgtgagaactgcatggagatggatgtgatgtcggtggccacaattgtcatagtggacatctgcatcactgggggct
tgctgctgctggtttactactggagcaagaatagaaaggccaaggccaagcctgtgacacgaggagcgggtgctggcggcaggcaaagg
ggacaaaacaaggagaggccaccacctgttcccaacccagactatgagcccatccggaaaggccagcgggacctgtattctggcctgaa
tcagagacgcatctgaccctctggagaacactgcctcccgctggcccaggtctcctctccagtcccctgcgactccctgtttcctggg
ctagtcttggacccacgagagagaatcgttcctcagcctcatggtgaactcgcgccctccagcctgatccccgctccctcctccctg
ccttctctgctggtacccagtcctaaaatattgctgcttcctcttcctttgaagcatcatcagtagtcacaccctcacagctggcctgc
cctcttgccaggatatttatttgtgctattcactcccttcccttggatgtaacttctccgttcagttccctcctttcttgcatgtaa
gttgtcccccatcccaaagtattccatctactttctatcgccgtccccttttgcagccctctctggggatggactgggtaaatgttga
cagaggccctgcccgttcacagatcctggccctgagccagccctgtgctcctcctcccccaacactccctaccaaccGCGgacCGAG
CGGCCGCAGGAACCCCTAGTGATGGAGTTGGCCACTCCCTCTCTGCGCGCTCGCTCGCTCACTGAGGCCGGGCGACCAAAGGTCGCCCG
ACGCCCGGGCTTTGCCCGGGCGGCCTCAGTGAGCGAGCGAGCGCGCAGCTGCCTGCAGG
``` complete sequence of vector for insertion of GFP into CD3e locus

SEQ ID NO: 3064

```
CCTGCAGGCAGCTGCGCGCTCGCTCGCTCACTGAGGCCGCCCGGGCGTCGGGCGACCTTTGGTCGCCCGGCCTCAGTGAGCGAGCGAGC
GCGCAGAGAGGGAGTGGCCAACTCCATCACTAGGGGTTCCTGCGGCCGCATCGATTGaattcAGGTAAGTCCACGAATCAGTGATTCAG
TGGTGTGGAGAGCTTTATTTCTGAGAAGGCCAGTAGCGCTCCCTTCTGACAAGCAAATCTAAGACCTGGATGACAGATGACTTCCTGCA
TTTGGTTGGTTCTTTTGTCATTCATATCTATCTGTAATACAGTTCTGGCTAATTTAAGAGGATAAGCTTGAAGACCTCTGGAATTTTTC
GGCTTTAGGACTTTAAGGCTTTCTGAGCTTCAGTAGATCTAGATCTAGGAGCTCATGCTGGTATATTCTGAATCCGATGTATCTGAGTT
ACATCTATGAGCTACTTAATAAATATATCTATGAGCTAAATCTCATAGGCTAAGCATGAACCTCACCTCCAAGACTCGGGGTTCCTAAA
TGGATGAGACCCTCTTTGGGAAGTCTTGTGGGCAGTGTCTAATTCCACTAGAAAAGTTTTACCTACAATTTAAACTTAAACCATGATAT
TTTCTTACTGCTGTTTCCTTTTTTCATTTTCAGGTGGTATTACACAGACACGTGAGTTTATTGGTCTTTTATTTATGCCCTGTCTGAGG
ATGCAGATTGGTGGGTAGATGAGAAGGAACTGATTGAGAGAGATTAACCCCAAGAACTGATATCTTCCCAGCATTGCATTCTCAACTCC
ATTTTAGAAAGGTTCCAAATAGGGACTTCTGTGGGTTTTTCTTTACATCCATCTTACCCTTCCCAAGTCCCCATGTCCCTGCGTAAACC
CTAAAGCCACCTCTCAAAAGGTTCTCTAGTTCCCTTCAAGGTTCTCTAGTTCCCTTCATTCCACATATCTCCTCTTCCACACCCTCTAG
CCAGTAGAGCTCCCTTCTGACAAGCAAGTCTAAGATCTAGATGACAGATGACTTCCTGCATTTGGGTGGTTCTTTTGTCACTAATTTGC
CTTTTCTAAAATTGTCCTGGTTTCTTCTGCCAATTTCCCTTCTTTCTCCCCAGCATATAAAGTCTCCATCTCTGGAACCACAatggcct
taccagtgaccgccttgctcctgccgctggccttgctgctccacgccgccaggccggatatccagatgacacagactacatcctccctg
```

-continued tctgcctctctgggagacagagtcaccatcagttgcagtgcaagtcagggcattagcaattatttaaactggtatcagcagaaaccaga
tggaactgttaaactcctgatctattacacatcaagtttacactcaggagtcccatcaaggttcagtggcagtgggtctgggacagatt
attctctcaccatcagcaacctggaacctgaagatattgccacttattattgtcagcagtatagcaagcttccgtacacgttcggaggg
gggaccaagctggaaataaaacgtggtggtggtggttctggtggtggtggttctggcggcggcggctccggtggtggtggatccgaggt
gcaactggtggagtctgggggaggcttagtgaagcctgggggtccctgaaactctcctgtgcagcctctggactcactttcagtagct
atgccatgtcttgggttcgccagactccagagaagaggctggagtgggtcgcatccattagtagtggtggtttcacctactatccagac
agtgtgaagggccgattcaccatctccagagataatgccaggaacatcctgtatctgcaaatgagcagtctgaggtctgaggacacggc
catgtattactgtgcaagagacgaggtacgggggtacctcgatgtctggggcgcagggaccacggtcaccgtttcccctaggGCTAGCa
ccacgacgccagcgccgcgaccaccaacaccggcgcccaccatcgcgtcgcagcccctgtccctgcgcccagaggcgtgccggccagcg
gcggggggcgcagtgcacacgaggggctggacttcgcctgtgattttgggtgctggtggtggttggtggagtcctggcttgctatag
cttgctagtaacagtggcctttattattttctgggtgaggagtaagaggagcaggctcctgcacagtgactacatgaacatgactcccc
gccgcccgggcccacccgcaagcattaccagccctatgccccaccacgcgacttcgcagcctatcgctccagagtgaagttcagcagg
agcgcagacgcccccgcgtacaagcagggccagaaccagctctataacgagctcaatctaggacgaagagaggagtacgatgttttgga
caagagacgtggccgggaccctgagatgggggaaagccgagaaggaagaaccctcaggaaggcctgtacaatgaactgcagaaagata
agatggcggaggcctacagtgagattgggatgaaaggcgagcgccggaggggcaaggggcacgatggcctttaccagggtctcagtaca
gccaccaaggacacctacgacgcccttcacatgcaggccctgccccctcgcCGGACCGATggaagcggagctactaacttcagcctgct
gaagcaggctggagacgtggaggagaaccctggacctgtttctgaagccatgccgcggggctggaccgcgctttgcttgctgagtttgc
tgccttctgggttcatgagtcttgacaacaacggtactgctaccccagagttacctacccagggaacattttcaaatgtttctacaaat
gtatcctaccaagaaactacaacacctgtacccttggaagtaccagcctgcaccctgtgtctcaacatggcaatgaggccacaacaaa
catcacagaaacgacagtcaaattcacatctacctctgtgataacctcagtttatggaaacacaaactcttctgtccagtcacagacct
ctgtaatcagcacagtgttcaccaccccagccaacgtttcaactccagagacaaccttgaagcctagcctgtcacctggaaatgtttca
gacctttcaaccactagcactagccttgcaacatctcccactaaaccctatacatcatcttctcctatcctaagtgacatcaaggcaga
aatcaaatgttcaggcatcagagaagtgaaattgactcagggcatctgcctggagcaaaataagacctccagctgtgcggagtttaaga
aggacaggggagagggcctggcccgagtgctgtgtggggaggagcaggctgatgctgatgctggggcccaggtatgctccctgctcctt
gcccagtctgaggtgaggcctcagtgtctactgctggtcttggccaacagaacagaaatttccagcaaactccaacttatgaaaaagca
ccaatctgacctgaaaaagctggggatcctagatttcactgagcaagatgttgcaagccaccagagctattcccaaaagaccctgattg
cactggtcacctcgggagccctgctggctgtcttgggcatcactggctatttcctgatgaatcgccgcagctggagcccatttaaACG
GGTGGCATCCCTGTGACCCCTCCCCAGTGCCTCTCCTGGCCCTGGAAGTTGCCACTCCAGTGCCCACCAGCCTTGTCCTAATAAAATTA
AGTTGCATCATTTTGTCTGACTAGGTGTCCTTCTATAATATTATGGGGTGGAGGGGGGTGGTATGGAGCAAGGGGCAAGTTGGGAAGAC
AACCTGTAGGGCCTGCGGGGTCTATTGGGAACCAAGCTGGAGTGCAGTGGCACAATCTTGGCTCACTGCAATCTCCGCCTCCTGGGTTC
AAGCGATTCTCCTGCCTCAGCCTCCCGAGTTGTTGGGATTCCAGGCATGCATGACCAGGCTCAGCTAATTTTTGTTTTTTTGGTAGAGA
CGGGGTTTCACCATATTGGCCAGGCTGGTCTCCAACTCCTAATCTCAGGTGATCTACCCACCTTGGCCTCCCAAATTGCTGGGATTACA
GGCGTGAACCACTGCTCCCTTCCCTGTCCTTCTGATTTTGTAGGTAACCACaGTAtaatattgacatgccctcagtatcctggatctga
aatactatggcaacacaatgataaaaacataggcggtgatgaggatgataaaaacataggcagtgatgaggatcacctgtcactgaagg
aattttcagaattggagcaaagtggttattatgtctgctaccccagaggaagcaaaccagaagatgcgaacttttatctctacctgagg
gcaagagtgtgtgagaactgcatggagatggatgtgatgtcggtggccacaattgtcatagtggacatctgcatcactggggcttgct
gctgctggtttactactggagcaagaatagaaaggccaaggccaagcctgtgacacgaggagcgggtgctggcggcaggcaaaggggac
aaaacaaggagaggccaccacctgttcccaacccagactatgagcccatccggaaaggccagcgggacctgtattctggcctgaatcag
agacgcatctgaccctctggagaacactgcctcccgctggcccaggtctcctctccagtcccctgcgactccctgtttcctgggctag
tcttggaccccacgagagagaatcgttcctcagcctcatggtgaactcgcgcccctccagcctgatcccccgctccctcctccctgcctt
ctctgctggtacccagtcctaaaatattgctgcttcctcttccttttgaagcatcatcagtagtcacaccctcacagctggcctgccctc -continued

```
ttgccaggatatttatttgtgctattcactcccttcccttttggatgtaacttctccgttcagttccctcctttcttgcatgtaagttg tcccccatcccaaagtattccatctacttttctatcgccgtccccttttgcagccctctctggggatggactgggtaaatgttgacaga ggccctgcccgttcacagatcctggccctgagccagccctgtgctcctcctcccccaacactccctaccaaccGCGgacCGAGCGGC CGCAGGAACCCCTAGTGATGGAGTTGGCCACTCCCTCTCTGCGCGCTCGCTCGCTCACTGAGGCCGGGCGACCAAAGGTCGCCCGACGC

CCGGGCTTTGCCCGGGCGGCCTCAGTGAGCGAGCGAGCGCGCAGCTGCCTGCAGG
```

All references, patents or applications, U.S. or foreign, cited in the application are hereby incorporated by reference as if written herein in their entireties. Where any inconsistencies arise, material literally disclosed herein controls.

From the foregoing description, one skilled in the art can easily ascertain the essential characteristics of this invention, and without departing from the spirit and scope thereof, can make various changes and modifications of the invention to adapt it to various usages and conditions.

| | | | | | | | | | | | | | |
|---|---|---|---|---|---|---|---|---|---|---|---|---|---|
| E | 0.172 | 0.17 | 0.073 | 0.075 | 0.085 | 0.084 | 0.492 | 0.557 | 0.42 | 0.18 | 0.247 | 0.19 | 450 [Test] |
| | 0.046 | 0.045 | 0.044 | 0.046 | 0.045 | 0.045 | 0.05 | 0.053 | 0.05 | 0.048 | 0.048 | 0.047 | 540 [Ref] |
| | 0.698 | 0.691 | 0.161 | 0.161 | 0.222 | 0.216 | 2.46 | 2.796 | 2.054 | 0.735 | 1.107 | 0.794 | Pathlength |
| | 0.171 | 0.17 | 0.073 | 0.075 | 0.085 | 0.084 | 0.496 | 0.558 | 0.42 | 0.181 | 0.249 | 0.19 | 450 |
| | 0.046 | 0.046 | 0.045 | 0.047 | 0.045 | 0.045 | 0.05 | 0.053 | 0.051 | 0.048 | 0.049 | 0.047 | 540 |
| | 0.245 | 0.246 | 0.454 | 0.468 | 0.383 | 0.389 | 0.202 | 0.2 | 0.204 | 0.246 | 0.225 | 0.239 | Corrected [450] |
| | 0.066 | 0.066 | 0.277 | 0.291 | 0.204 | 0.209 | 0.02 | 0.019 | 0.025 | 0.066 | 0.044 | 0.059 | Corrected [540] |
| F | 0.127 | 0.124 | 0.07 | 0.074 | 0.075 | 0.072 | 0.148 | 0.143 | 0.128 | 0.102 | 0.115 | 0.121 | 450 [Test] |
| | 0.044 | 0.045 | 0.043 | 0.047 | 0.046 | 0.044 | 0.055 | 0.057 | 0.045 | 0.045 | 0.051 | 0.048 | 540 [Ref] |
| | 0.458 | 0.436 | 0.147 | 0.15 | 0.162 | 0.157 | 0.516 | 0.479 | 0.463 | 0.316 | 0.353 | 0.406 | Pathlength |
| | 0.127 | 0.124 | 0.07 | 0.074 | 0.075 | 0.072 | 0.147 | 0.144 | 0.129 | 0.102 | 0.116 | 0.12 | 450 |
| | 0.045 | 0.045 | 0.044 | 0.047 | 0.046 | 0.044 | 0.055 | 0.057 | 0.045 | 0.045 | 0.052 | 0.048 | 540 |
| | 0.277 | 0.283 | 0.475 | 0.493 | 0.465 | 0.462 | 0.286 | 0.3 | 0.278 | 0.323 | 0.328 | 0.296 | Corrected [450] |
| | 0.097 | 0.104 | 0.297 | 0.314 | 0.285 | 0.283 | 0.106 | 0.119 | 0.097 | 0.144 | 0.147 | 0.119 | Corrected [540] |
| G | 0.098 | 0.1 | 0.078 | 0.073 | 0.104 | 0.122 | 0.143 | 0.169 | 0.144 | 0.125 | 0.134 | 0.131 | 450 [Test] |
| | 0.044 | 0.044 | 0.046 | 0.044 | 0.045 | 0.05 | 0.049 | 0.049 | 0.05 | 0.05 | 0.045 | 0.046 | 540 [Ref] |
| | 0.301 | 0.313 | 0.179 | 0.161 | 0.326 | 0.398 | 0.523 | 0.667 | 0.523 | 0.415 | 0.493 | 0.469 | Pathlength |
| | 0.099 | 0.101 | 0.078 | 0.073 | 0.103 | 0.122 | 0.144 | 0.169 | 0.144 | 0.125 | 0.133 | 0.13 | 450 |
| | 0.044 | 0.044 | 0.046 | 0.044 | 0.045 | 0.05 | 0.05 | 0.049 | 0.05 | 0.05 | 0.045 | 0.045 | 540 |
| | 0.328 | 0.322 | 0.437 | 0.452 | 0.317 | 0.306 | 0.275 | 0.254 | 0.275 | 0.301 | 0.269 | 0.277 | Corrected [450] |
| | 0.148 | 0.142 | 0.259 | 0.272 | 0.138 | 0.127 | 0.095 | 0.074 | 0.096 | 0.12 | 0.091 | 0.096 | Corrected [540] |
| H | 0.082 | 0.087 | 0.113 | 0.12 | 0.074 | 0.081 | 0.165 | 0.169 | 0.15 | 0.103 | 0.122 | 0.119 | 450 [Test] |
| | 0.047 | 0.051 | 0.049 | 0.047 | 0.047 | 0.053 | 0.055 | 0.059 | 0.045 | 0.044 | 0.046 | 0.044 | 540 [Ref] |
| | 0.197 | 0.197 | 0.356 | 0.406 | 0.15 | 0.157 | 0.611 | 0.607 | 0.579 | 0.329 | 0.422 | 0.412 | Pathlength |
| | 0.082 | 0.087 | 0.113 | 0.12 | 0.074 | 0.081 | 0.165 | 0.169 | 0.15 | 0.103 | 0.122 | 0.118 | 450 |
| | 0.047 | 0.052 | 0.049 | 0.047 | 0.047 | 0.053 | 0.055 | 0.06 | 0.046 | 0.044 | 0.046 | 0.045 | 540 |
| | 0.415 | 0.443 | 0.316 | 0.296 | 0.493 | 0.516 | 0.27 | 0.279 | 0.259 | 0.314 | 0.289 | 0.288 | Corrected [450] |
| | 0.236 | 0.263 | 0.137 | 0.117 | 0.311 | 0.338 | 0.09 | 0.098 | 0.079 | 0.134 | 0.11 | 0.109 | Corrected [540] |

SEQUENCE LISTING (3082 sequences)

SEQ ID NO: 1 - protein, 21 aa, Artificial Sequence
  Description of Artificial Sequence: Synthetic peptide
MALPVTALLLPLALLLHAARP

SEQ ID NO: 2 - protein, 45 aa, Artificial Sequence
  Description of Artificial Sequence: Synthetic polypeptide
TTTPAPRPPTPAPTIASQPLSLRPEACRPAAGGAVHTRGLDFACD

SEQ ID NO: 3 - protein, 27 aa, Artificial Sequence
  Description of Artificial Sequence: Synthetic peptide
FWVLVVVGGVLACYSLLVTVAFIIFWV

SEQ ID NO: 4 - protein, 235 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 5 - protein, 42 aa, Artificial Sequence
  Description of Artificial Sequence: Synthetic polypeptide
KRGRKKLLYIFKQPFMRPVQTTQEEDGCSCRFPEEEEGGCEL

SEQ ID NO: 6 - protein, 41 aa, Artificial Sequence
  Description of Artificial Sequence: Synthetic polypeptide
RSKRSRLLHSDYMNMTPRRPGPTRKHYQPYAPPRDFAAYRS

SEQ ID NO: 7 - protein, 112 aa, Artificial Sequence
  Description of Artificial Sequence: Synthetic polypeptide
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8 - protein, 22 aa, Artificial Sequence
  Description of Artificial Sequence: Synthetic peptide
GSGATNFSLLKQAGDVEENPGP

SEQ ID NO: 9 - protein, 20 aa, Artificial Sequence
  Description of Artificial Sequence: Synthetic peptide
GGGGSGGGGSGGGGSGGGGS

SEQ ID NO: 10 - protein, 308 aa, Artificial Sequence
  Description of Artificial Sequence: Synthetic polypeptide
MPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

SEQ ID NO: 11 - protein, 710 aa, Artificial Sequence
  Description of Artificial Sequence: Synthetic polypeptide
MPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGEGGGGGDLGGVKLPHLFGKRLVEARMASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHVGGEAGSSHAPPPALTLLLDRHPIAVMLCYPAARYLMGSMTPQAVLAFVALIPPTLPGTNIVLGALPEDRHIDRLAKRQRPGERLDLAMLAAIRRVYGLLANTVRYLQGGGSWWEDWGQLSGTAVPPQGAEPQSNAGPRPHIGDTLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 12 - protein, 119 aa, Artificial Sequence
  Description of Artificial Sequence: Synthetic polypeptide
EVKLEESGAELVKPGASVKLSCRTSGFNLKDTIHWVKQRPEQGLKWIGRIDPANGNTKYDPKFQDKATVTADTSSNTAYLQLSSLTSEDTAVYYCVTYAYDGNWYFDVWGAGTAVTVSS

SEQ ID NO: 13 - protein, 109 aa, Artificial Sequence
  Description of Artificial Sequence: Synthetic polypeptide
DIKNITQSPSSMYVSLGERVTITCKASQDINSFLSWFQQKPGKSPKTLIYRANRLVDGVPSRFSGSGSGQDYSLTISSLEYEDMEIYYCLQYDEFPYTFGGGTKLEMKR

SEQ ID NO: 14 - protein, 121 aa, Artificial Sequence
  Description of Artificial Sequence: Synthetic polypeptide
EVQLEESGAELVRPGTSVKLSCKASGYTFTSYWMHWIKQRPEQGLEWIGRIDPYDSETHYNEKFKDKAILSVDKSSSTAYIQLSSLTSDDSAVYYCSRRDAKYDGYALDYWGQGTSVTVSS

SEQ ID NO: 15 - protein, 113 aa, Artificial Sequence
  Description of Artificial Sequence: Synthetic polypeptide
DIVMTQAAPSVPVTPGESVSISCRSSKTLLHSNGNTYLYWFLQRPGQSPQVLIYRMSNLASGVPNRFSGSGSETTFTLRISRVEAEDVGIYYCMQHLEYPYTFGGGTKLEIER

SEQ ID NO: 16 - protein, 121 aa, Artificial Sequence
  Description of Artificial Sequence: Synthetic polypeptide
GSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 17 - protein, 107 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 18 - protein, 122 aa, Artificial Sequence
  Description of Artificial Sequence: Synthetic polypeptide
EVQLVESGGGLVQPGGSLRLSCAASGYSFTGYTMNWVRQAPGKCLEWVALINPYKGVSTYNQKFKDRFTISVDKSKNTAYLQMNSLRAEDTAVYYCARSGYYGDSDWYFDVWGQGTLVTVSS

SEQ ID NO: 19 - protein, 107 aa, Artificial Sequence
  Description of Artificial Sequence: Synthetic polypeptide
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGCGTKVEIK

SEQ ID NO: 20 - protein, 116 aa, Artificial Sequence
  Description of Artificial Sequence: Synthetic polypeptide
EVQLVESGGGLVKPGGSLKLSCAASGLTFSSYAMSWVRQTPEKRLEWVASISSGGFTYYPDSVKGRFTISRDNARNILYLQMSSLRSEDTAMYYCARDEVRGYLDVWGAGTTVTVS

SEQ ID NO: 21 - protein, 108 aa, Artificial Sequence
  Description of Artificial Sequence: Synthetic polypeptide
DIQMTQTTSSLSASLGDRVTISCSASQGISNYLNWYQQKPDGTVKLLIYYTSSLHSGVPSRFSGSGSGTDYSLTISNLEPEDIATYYCQQYSKLPYTFGGGTKLEIKR

SEQ ID NO: 22 - protein, 119 aa, Artificial Sequence
  Description of Artificial Sequence: Synthetic polypeptide
EVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGVGAHDAFDIWGQGTTVTVSS

SEQ ID NO: 23 - protein, 112 aa, Artificial Sequence
  Description of Artificial Sequence: Synthetic polypeptide
DVVMTQSPLSLPVTPGEPASISCRSSQSLLHSNGNNYLDWYLQKPGQSPQLLIYLGSNRASGVPDRFSGSGSDTDFTLQISRVEAEDVGVYYCMQGTHPAISFGQGTRLEIK

SEQ ID NO: 24 - protein, 122 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSS

SEQ ID NO: 25 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIK

SEQ ID NO: 26 - protein, 118 aa, Artificial Sequence
  Description of Artificial Sequence: Synthetic polypeptide
EVQLVQSGAEVKKPGASVKVSCKASGYTFTSYYMHWARQAPGQGLEWMGIINPSGGSTSYAQKFQGRVTMTRDTSTSTVYMELSSLRSEDTAVYYCARVVAAAVADYWGQGTLVTVSS

SEQ ID NO: 27 - protein, 112 aa, Artificial Sequence
  Description of Artificial Sequence: Synthetic polypeptide
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQSLQTPFTFGPGTKVDIK

SEQ ID NO: 28 - protein, 120 aa, Artificial Sequence
  Description of Artificial Sequence: Synthetic polypeptide
QVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSS

SEQ ID NO: 29 - protein, 107 aa, Artificial Sequence
  Description of Artificial Sequence: Synthetic polypeptide
DIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELK

SEQ ID NO: 30 - protein, 120 aa, Artificial Sequence
  Description of Artificial Sequence: Synthetic polypeptide
QVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSSG

SEQ ID NO: 31 - protein, 115 aa, Artificial Sequence
  Description of Artificial Sequence: Synthetic polypeptide
GSEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKR

SEQ ID NO: 32 - protein, 832 aa, Artificial Sequence
  Description of Artificial Sequence: Synthetic polypeptide
MALPVTALLLPLALLLHAARPDIQMTQTTSSLSASLGDRVTISCSASQGISNYLNWYQQKPDGTVKLLIYYTSSLHSGVPSRFSGSGSGTDYSLTISNLEPEDIATYYCQQYSKLPYTFGGGTKLEIKRGGGGSGGGGSGGGGSGGGGSEVQLVESGGGLVKPGGSLKLSCAASGLTFSSYAMSWVRQTPEKRLEWVASISSGGFTYYPDSVKGRFTISRDNARNILYLQMSSLRSEDTAMYYCARDEVRGYLDVWGAGTTVTVSPRASTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRTDGSGATNFSLLKQAGDVEENPGPVSEAMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

SEQ ID NO: 33 - protein, 1234 aa, Artificial Sequence
  Description of Artificial Sequence: Synthetic polypeptide
MALPVTALLLPLALLLHAARPDIQMTQTTSSLSASLGDRVTISCSASQGISNYLNWYQQKPDGTVKLLIYYTSSLHSGVPSRFSGSGSGTDYSLTISNLEPEDIATYYCQQYSKLPYTFGGGTKLEIKRGGGGSGGGGSGGGGSGGGGSEVQLVESGGGLVKPGGSLKLSCAASGLTFSSYAMSWVRQTPEKRLEWVASISSGGFTYYPDSVKGRFTISRDNARNILYLQMSSLRSEDTAMYYCARDEVRGYLDVWGAGTTVTVSPRASTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRTDGSGATNFSLLKQAGDVEENPGPVSEAMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGEGGGGGDLGGVKLPHLFGKRLVEARMASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHVGGEAGSSHAPPPALTLLLDRHPIAVMLCYPAARYLMGSMTPQAVLAFVALIPPTLPGTNIVLGALPEDRHIDRLAKRQRPGERLDLAMLAAIRRVYGLLANTVRYLQGGGSWWEDWGQLSGTAVPPQGAEPQSNAGPRPHIGDTLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 34 - protein, 831 aa, Artificial Sequence
  Description of Artificial Sequence: Synthetic polypeptide
MALPVTALLLPLALLLHAARPDIQMTQTTSSLSASLGDRVTISCSASQGISNYLNWYQQKPDGTVKLLIYYTSSLHSGVPSRFSGSGSGTDYSLTISNLEPEDIATYYCQQYSKLPYTFGGGTKLEIKRGGGGSGGGGSGGGGSGGGGSEVQLVESGGGLVKPGGSLKLSCAASGLTFSSYAMSWVRQTPEKRLEWVASISSGGFTYYPDSVKGRFTISRDNARNILYLQMSSLRSEDTAMYYCARDEVRGYLDVWGAGTTVTVSPRASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRTDGSGATNFSLLKQAGDVEENPGPVSEAMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

SEQ ID NO: 35 - protein, 1233 aa, Artificial Sequence
  Description of Artificial Sequence: Synthetic polypeptide
MALPVTALLLPLALLLHAARPDIQMTQTTSSLSASLGDRVTISCSASQGISNYLNWYQQKPDGTVKLLIYYTSSLHSGVPSRFSGSGSGTDYSLTISNLEPEDIATYYCQQYSKLPYTFGGGTKLEIKRGGGGSGGGGSGGGGSGGGGSEVQLVESGGGLVKPGGSLKLSCAASGLTFSSYAMSWVRQTPEKRLEWVASISSGGFTYYPDSVKGRFTISRDNARNILYLQMSSLRSEDTAMYYCARDEVRGYLDVWGAGTTVTVSPRASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRTDGSGATNFSLLKQAGDVEENPGPVSEAMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGEGGGGGDLGGVKLPHLFGKRLVEARMASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHVGGEAGSSHAPPPALTLLLDRHPIAVMLCYPAARYLMGSMTPQAVLAFVALIPPTLPGTNIVLGALPEDRHIDRLAKRQRPGERLDLAMLAAIRRVYGLLANTVRYLQGGGSWWEDWGQLSGTAVPPQGAEPQSNAGPRPHIGDTLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 36 - protein, 1248 aa, Artificial Sequence
  Description of Artificial Sequence: Synthetic polypeptide
MALPVTALLLPLALLLHAARPGSDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSPRASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRTDGSGATNFSLLKQAGDVEENPGPVSEAMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGEGGGGGFKRDLGGVKLPHLFGKRLVEARMASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHVGGEAGSSHAPPPALTLLLDRHPIAVMLCYPAARYLMGSMTPQAVLAFVALIPPTLPGTNIVLGALPEDRHIDRLAKRQRPGERLDLAMLAAIRRVYGLLANTVRYLQGGGSWWEDWGQLSGTAVPPQGAEPQSNAGPRPHIGDTLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 37 - protein, 841 aa, Artificial Sequence
  Description of Artificial Sequence: Synthetic polypeptide
MALPVTALLLPLALLLHAARPDIVMTQAAPSVPVTPGESVSISCRSSKTLLHSNGNTYLYWFLQRPGQSPQVLIYRMSNLASGVPNRFSGSGSETTFTLRISRVEAEDVGIYYCMQHLEYPYTFGGGTKLEIERGGGGSGGGGSGGGGSGGGGSEVQLEESGAELVRPGTSVKLSCKASGYTFTSYWMHWIKQRPEQGLEWIGRIDPYDSETHYNEKFKDKAILSVDKSSSTAYIQLSSLTSDDSAVYYCSRRDAKYDGYALDYWGQGTSVTVSSPRASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRTDGSGATNFSLLKQAGDVEENPGPVSEAMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

SEQ ID NO: 38 - protein, 842 aa, Artificial Sequence
  Description of Artificial Sequence: Synthetic polypeptide
MALPVTALLLPLALLLHAARPDIVMTQAAPSVPVTPGESVSISCRSSKTLLHSNGNTYLYWFLQRPGQSPQVLIYRMSNLASGVPNRFSGSGSETTFTLRISRVEAEDVGIYYCMQHLEYPYTFGGGTKLEIERGGGGSGGGGSGGGGSGGGGSEVQLEESGAELVRPGTSVKLSCKASGYTFTSYWMHWIKQRPEQGLEWIGRIDPYDSETHYNEKFKDKAILSVDKSSSTAYIQLSSLTSDDSAVYYCSRRDAKYDGYALDYWGQGTSVTVSSPRASTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRTDGSGATNFSLLKQAGDVEENPGPVSEAMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

SEQ ID NO: 39 - protein, 835 aa, Artificial Sequence
  Description of Artificial Sequence: Synthetic polypeptide
MALPVTALLLPLALLLHAARPGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSGGGGSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRPRASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRTDGSGATNFSLLKQAGDVEENPGPVSEAMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

SEQ ID NO: 40 - RNA, 100 nt, Artificial Sequence
  Description of Artificial Sequence: Synthetic polynucleotide
aucacggaggucaaugucuaguuuuagagcuagaaauagcaaguuaaaauaaggcuaguccguuaucaacuugaaaaaguggcaccgagucggugcuuuu

SEQ ID NO: 41 - RNA, 100 nt, Artificial Sequence
  Description of Artificial Sequence: Synthetic polynucleotide
guagacauugaccuccgugaguuuuagagcuagaaauagcaaguuaaaauaaggcuaguccguuaucaacuugaaaaaguggcaccgagucggugcuuuu

SEQ ID NO: 42 - RNA, 100 nt, Artificial Sequence; identical to SEQ ID NO: 40
  Description of Artificial Sequence: Synthetic polynucleotide

SEQ ID NO: 43 - RNA, 100 nt, Artificial Sequence
  Description of Artificial Sequence: Synthetic polynucleotide
gagaaucaaaaucggugaauguuuuagagcuagaaauagcaaguuaaaauaaggcuaguccguuaucaacuugaaaaaguggcaccgagucggugcuuuu

SEQ ID NO: 44 - RNA, 100 nt, Artificial Sequence
  Description of Artificial Sequence: Synthetic polynucleotide
gaccaaucugacaugcugcaguuuuagagcuagaaauagcaaguuaaaauaaggcuaguccguuaucaacuugaaaaaguggcaccgagucggugcuuuu

SEQ ID NO: 45 - RNA, 100 nt, Artificial Sequence
  Description of Artificial Sequence: Synthetic polynucleotide
acagcugacaggcucgacacguuuuagagcuagaaauagcaaguuaaaauaaggcuaguccguuaucaacuugaaaaaguggcaccgagucggugcuuuu

SEQ ID NO: 46 - RNA, 100 nt, Artificial Sequence; identical to SEQ ID NO: 43
  Description of Artificial Sequence: Synthetic polynucleotide

SEQ ID NO: 47 - RNA, 100 nt, Artificial Sequence
  Description of Artificial Sequence: Synthetic polynucleotide
agggcaugucaauauuacugguuuuagagcuagaaauagcaaguuaaaauaaggcuaguccguuaucaacuugaaaaaguggcaccgagucggugcuuuu

SEQ ID NO: 48 - RNA, 100 nt, Artificial Sequence
  Description of Artificial Sequence: Synthetic polynucleotide
cguuccaacucgaagugccaguuuuagagcuagaaauagcaaguuaaaauaaggcuaguccguuaucaacuugaaaaaguggcaccgagucggugcuuuu

SEQ ID NO: 49 - RNA, 100 nt, Artificial Sequence; identical to SEQ ID NO: 48
  Description of Artificial Sequence: Synthetic polynucleotide

SEQ ID NO: 50 - RNA, 100 nt, Artificial Sequence
  Description of Artificial Sequence: Synthetic polynucleotide
uacucagguucaggagacgcguuuuagagcuagaaauagcaaguuaaaauaaggcuaguccguuaucaacuugaaaaaguggcaccgagucggugcuuuu

SEQ ID NO: 51 - DNA, 141 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 52 - DNA, 232 bp, Artificial Sequence
  Description of Artificial Sequence: Synthetic polynucleotide
ggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagg

SEQ ID NO: 53 - DNA, 927 bp, Artificial Sequence
  Description of Artificial Sequence: Synthetic polynucleotide
atgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccatttaa

SEQ ID NO: 54 - DNA, 1000 bp, Artificial Sequence
  Description of Artificial Sequence: Synthetic polynucleotide
cctgagatggatgcagccacagccctggagccagcctgaagctcctggtgtcttctgggggctacatataggagtgtagtccgaacctcagaggggcaaacctgctctgcagagggaatcaaggttcacataaccagagaggggagtcactcaggaaggtggctccagagccaagagtcagactctgggtcccgacttgacccagccacaccccctctgaagcttgctgagagtggctgcagtctcgctgctggatgtgcacatggtggtcattccctctgctcacaggggcaggggtccccccttactggactgaggttgccccctgctccaggtcctgggtgggagcccatgtgaactgtcagtggggcaggtctgtgagagctcccctcacactcaagtctctcacagtggccagagaagaggaaggctggagtcagaatgaggcaccagggcgggcatagcctgcccaaaggcccctgggattacaggcaggatggggagccctatctaagtgtctcccacgccccaccccagccattccaggccaggaagtccaaactgtgcccctcagagggagggggcagcctcaggcccattcagactgcccagggagggctggagagccctcaggaaggcgggtgggtgggctgtcggttcttggaaaggttcattaatgaaaacccccaagcctgaccacctagggaaaaggctcaccgttcccatgtgtggctgataagggccaggagattccacagttcaggtagttcccccgcctccctggcattttgtggtcaccattaatcatttcctctgtgtatttaagagctcttttgccagtgagcccagtacacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggccc

SEQ ID NO: 55 - DNA, 130 bp, Artificial Sequence
  Description of Artificial Sequence: Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcct

SEQ ID NO: 56 - RNA, 20 nt, Artificial Sequence
  Description of Artificial Sequence: Synthetic oligonucleotide
gacaaaucaaucuacaaacc

SEQ ID NO: 57 - RNA, 20 nt, Artificial Sequence
  Description of Artificial Sequence: Synthetic oligonucleotide
gguccgcuucuuaaauucuu

SEQ ID NO: 58 - RNA, 20 nt, Artificial Sequence
  Description of Artificial Sequence: Synthetic oligonucleotide
uccucauuggaugaagacuu

SEQ ID NO: 59 - RNA, 20 nt, Artificial Sequence
  Description of Artificial Sequence: Synthetic oligonucleotide
aacugagaacucaagucagc

SEQ ID NO: 60 - RNA, 20 nt, Artificial Sequence
  Description of Artificial Sequence: Synthetic oligonucleotide
gaaggaaucauucacaccau

SEQ ID NO: 61 - RNA, 20 nt, Artificial Sequence
  Description of Artificial Sequence: Synthetic oligonucleotide
acacuggugaggaugaagaa

SEQ ID NO: 62 - RNA, 20 nt, Artificial Sequence
  Description of Artificial Sequence: Synthetic oligonucleotide
ucggcauccucaguggcgag

SEQ ID NO: 63 - RNA, 20 nt, Artificial Sequence
  Description of Artificial Sequence: Synthetic oligonucleotide
gcaugaaggccacuucaucc

SEQ ID NO: 64 - RNA, 20 nt, Artificial Sequence
  Description of Artificial Sequence: Synthetic oligonucleotide
aaaucaggcuauagaagacu

SEQ ID NO: 65 - RNA, 20 nt, Artificial Sequence
  Description of Artificial Sequence: Synthetic oligonucleotide
uagagcaggacgcuuuuguu

SEQ ID NO: 66 - RNA, 20 nt, Artificial Sequence
  Description of Artificial Sequence: Synthetic oligonucleotide
cggcaugauugccaacuccg

SEQ ID NO: 67 - RNA, 20 nt, Artificial Sequence
  Description of Artificial Sequence: Synthetic oligonucleotide
cccacaggucggcaauggcc

SEQ ID NO: 68 - RNA, 20 nt, Artificial Sequence
  Description of Artificial Sequence: Synthetic oligonucleotide
ucuuucccugcucauaaacc

SEQ ID NO: 69 - RNA, 20 nt, Artificial Sequence
  Description of Artificial Sequence: Synthetic oligonucleotide
uccucacugagcaucaacga

SEQ ID NO: 70 - RNA, 20 nt, Artificial Sequence
  Description of Artificial Sequence: Synthetic oligonucleotide
cucuacauguguguguguga

SEQ ID NO: 71 - RNA, 20 nt, Artificial Sequence
  Description of Artificial Sequence: Synthetic oligonucleotide
cuacaacgccaacugggagc

SEQ ID NO: 72 - RNA, 20 nt, Artificial Sequence
  Description of Artificial Sequence: Synthetic oligonucleotide
gccagagcuguugcgccagg

SEQ ID NO: 73 - RNA, 20 nt, Artificial Sequence
  Description of Artificial Sequence: Synthetic oligonucleotide
augacuucaacugcuacgau

SEQ ID NO: 74 - RNA, 20 nt, Artificial Sequence
  Description of Artificial Sequence: Synthetic oligonucleotide
agacccugugaagccgucuc

SEQ ID NO: 75 - RNA, 20 nt, Artificial Sequence
  Description of Artificial Sequence: Synthetic oligonucleotide
ggccuaccugccggggggcc

SEQ ID NO: 76 - RNA, 20 nt, Artificial Sequence
  Description of Artificial Sequence: Synthetic oligonucleotide
ggggcugcgggaacuugcac

SEQ ID NO: 77 - RNA, 20 nt, Artificial Sequence
  Description of Artificial Sequence: Synthetic oligonucleotide
gggcucaggaugcuguugcu

SEQ ID NO: 78 - RNA, 20 nt, Artificial Sequence
  Description of Artificial Sequence: Synthetic oligonucleotide
cgugguuuccuggucaugac

SEQ ID NO: 79 - RNA, 20 nt, Artificial Sequence
  Description of Artificial Sequence: Synthetic oligonucleotide
gggggccugcacagguugga

SEQ ID NO: 80 - RNA, 20 nt, Artificial Sequence
  Description of Artificial Sequence: Synthetic oligonucleotide
acggacucgguaguuggacu

SEQ ID NO: 81 - RNA, 20 nt, Artificial Sequence
  Description of Artificial Sequence: Synthetic oligonucleotide
cugucgggauccaggaugag

SEQ ID NO: 82 - RNA, 20 nt, Artificial Sequence
  Description of Artificial Sequence: Synthetic oligonucleotide
uccccagggaggaggccccu

SEQ ID NO: 83 - RNA, 20 nt, Artificial Sequence
  Description of Artificial Sequence: Synthetic oligonucleotide
cggggaaugcugugcggcuu

SEQ ID NO: 84 - RNA, 20 nt, Artificial Sequence
  Description of Artificial Sequence: Synthetic oligonucleotide
gaagagcccgugccccagcg

SEQ ID NO: 85 - RNA, 20 nt, Artificial Sequence
  Description of Artificial Sequence: Synthetic oligonucleotide
gcauucguugcuguaggugg

SEQ ID NO: 86 - RNA, 20 nt, Artificial Sequence
  Description of Artificial Sequence: Synthetic oligonucleotide
uugauuccuucagcugggau

SEQ ID NO: 87 - RNA, 20 nt, Artificial Sequence
  Description of Artificial Sequence: Synthetic oligonucleotide
guaaagccaaucccagcuga

SEQ ID NO: 88 - RNA, 20 nt, Artificial Sequence
  Description of Artificial Sequence: Synthetic oligonucleotide
uugacuugauuccuucagcu

SEQ ID NO: 89 - RNA, 20 nt, Artificial Sequence
  Description of Artificial Sequence: Synthetic oligonucleotide
uuugacuugauuccuucagc

SEQ ID NO: 90 - RNA, 20 nt, Artificial Sequence
  Description of Artificial Sequence: Synthetic oligonucleotide
aaccaauucgaagauccaga

SEQ ID NO: 91 - RNA, 20 nt, Artificial Sequence
  Description of Artificial Sequence: Synthetic oligonucleotide
uauguggaagaaguagaugu

SEQ ID NO: 92 - RNA, 20 nt, Artificial Sequence
  Description of Artificial Sequence: Synthetic oligonucleotide
caagaggaacaugauucacc

SEQ ID NO: 93 - RNA, 20 nt, Artificial Sequence
  Description of Artificial Sequence: Synthetic oligonucleotide
gguccaauccagcagcauaa

SEQ ID NO: 94 - RNA, 20 nt, Artificial Sequence
  Description of Artificial Sequence: Synthetic oligonucleotide
ccacagugcugauggauuug

SEQ ID NO: 95 - RNA, 20 nt, Artificial Sequence
  Description of Artificial Sequence: Synthetic oligonucleotide
agaaggcauuucacucacag

SEQ ID NO: 96 - RNA, 20 nt, Artificial Sequence
  Description of Artificial Sequence: Synthetic oligonucleotide
cuguaaagaugcuauagaac

SEQ ID NO: 97 - RNA, 20 nt, Artificial Sequence
  Description of Artificial Sequence: Synthetic oligonucleotide
cacuaagguugcauuucaac

SEQ ID NO: 98 - RNA, 20 nt, Artificial Sequence
  Description of Artificial Sequence: Synthetic oligonucleotide
gaucuagauugaucacacua

SEQ ID NO: 99 - RNA, 20 nt, Artificial Sequence
  Description of Artificial Sequence: Synthetic oligonucleotide
aaucccucaggguugaucuc

SEQ ID NO: 100 - RNA, 20 nt, Artificial Sequence
  Description of Artificial Sequence: Synthetic oligonucleotide
cagcggcaggcgggccacgc

SEQ ID NO: 101 - RNA, 20 nt, Artificial Sequence
  Description of Artificial Sequence: Synthetic oligonucleotide
ggccgacuacaccuaugacc

SEQ ID NO: 102 - RNA, 20 nt, Artificial Sequence
  Description of Artificial Sequence: Synthetic oligonucleotide
ggcgcucacccgccuugcag

SEQ ID NO: 103 - RNA, 20 nt, Artificial Sequence
  Description of Artificial Sequence: Synthetic oligonucleotide
gaaacucauccuucaugcuc

SEQ ID NO: 104 - RNA, 20 nt, Artificial Sequence
  Description of Artificial Sequence: Synthetic oligonucleotide
agggacauaucuucuuccag

SEQ ID NO: 105 - RNA, 20 nt, Artificial Sequence
  Description of Artificial Sequence: Synthetic oligonucleotide
cagaaaccaaguaagcugcc

SEQ ID NO: 106 - RNA, 20 nt, Artificial Sequence
  Description of Artificial Sequence: Synthetic oligonucleotide
cgugcuuuucauggaacaca

SEQ ID NO: 107 - RNA, 20 nt, Artificial Sequence
  Description of Artificial Sequence: Synthetic oligonucleotide
cccuacuuugccccugauug

SEQ ID NO: 108 - RNA, 20 nt, Artificial Sequence
  Description of Artificial Sequence: Synthetic oligonucleotide
agugaaugcccuaggagccg

SEQ ID NO: 109 - RNA, 20 nt, Artificial Sequence
  Description of Artificial Sequence: Synthetic oligonucleotide
cgcaggucgaccaugguggc

SEQ ID NO: 110 - RNA, 20 nt, Artificial Sequence
  Description of Artificial Sequence: Synthetic oligonucleotide
gggccgcaggaaguucgcgg

SEQ ID NO: 111 - RNA, 20 nt, Artificial Sequence
  Description of Artificial Sequence: Synthetic oligonucleotide
gccgcaacucgaacucgcuc

SEQ ID NO: 112 - RNA, 20 nt, Artificial Sequence
  Description of Artificial Sequence: Synthetic oligonucleotide
aggcugcucuuucuguggcu

SEQ ID NO: 113 - RNA, 20 nt, Artificial Sequence
  Description of Artificial Sequence: Synthetic oligonucleotide
ggcacagcuuugcggagcuc

SEQ ID NO: 114 - RNA, 20 nt, Artificial Sequence
  Description of Artificial Sequence: Synthetic oligonucleotide
cgagcugcagccgcaagaca

SEQ ID NO: 115 - RNA, 20 nt, Artificial Sequence
  Description of Artificial Sequence: Synthetic oligonucleotide
uucgugguggaagcuccuca

SEQ ID NO: 116 - RNA, 20 nt, Artificial Sequence
  Description of Artificial Sequence: Synthetic oligonucleotide
gaagagcagauccacagcac

SEQ ID NO: 117 - RNA, 20 nt, Artificial Sequence
  Description of Artificial Sequence: Synthetic oligonucleotide
cacucuugcuaggcugcggg

SEQ ID NO: 118 - RNA, 20 nt, Artificial Sequence
  Description of Artificial Sequence: Synthetic oligonucleotide
acugaguacuccgacucuuc

SEQ ID NO: 119 - RNA, 20 nt, Artificial Sequence
  Description of Artificial Sequence: Synthetic oligonucleotide
agacccagaccauuuucacc

SEQ ID NO: 120 - RNA, 20 nt, Artificial Sequence
  Description of Artificial Sequence: Synthetic oligonucleotide
cgaaagacgggaaauacaaa

SEQ ID NO: 121 - RNA, 20 nt, Artificial Sequence
  Description of Artificial Sequence: Synthetic oligonucleotide
gaugcagaaggagaucuugu

SEQ ID NO: 122 - RNA, 20 nt, Artificial Sequence
  Description of Artificial Sequence: Synthetic oligonucleotide
ggcuguuggaggccgugcag

SEQ ID NO: 123 - RNA, 20 nt, Artificial Sequence
  Description of Artificial Sequence: Synthetic oligonucleotide
ccucgcggagagcccccucc

SEQ ID NO: 124 - RNA, 20 nt, Artificial Sequence
  Description of Artificial Sequence: Synthetic oligonucleotide
ucucauugucgaagcguucc

SEQ ID NO: 125 - RNA, 20 nt, Artificial Sequence
  Description of Artificial Sequence: Synthetic oligonucleotide
gccgugacagcuuccccuuc

SEQ ID NO: 126 - RNA, 20 nt, Artificial Sequence
  Description of Artificial Sequence: Synthetic oligonucleotide
ucuuccaguggaacaugaca

SEQ ID NO: 127 - RNA, 20 nt, Artificial Sequence
  Description of Artificial Sequence: Synthetic oligonucleotide
ccagaagccagagcgguccg

SEQ ID NO: 128 - RNA, 20 nt, Artificial Sequence
  Description of Artificial Sequence: Synthetic oligonucleotide
uggcggugcucgggcuaccc

SEQ ID NO: 129 - RNA, 20 nt, Artificial Sequence
  Description of Artificial Sequence: Synthetic oligonucleotide
uggcggugcucgggcuaccc

SEQ ID NO: 130 - RNA, 20 nt, Artificial Sequence
  Description of Artificial Sequence: Synthetic oligonucleotide
cggugcucgggcugccuggg

SEQ ID NO: 131 - RNA, 20 nt, Artificial Sequence
  Description of Artificial Sequence: Synthetic oligonucleotide
cccaggagccagagcgggcc

SEQ ID NO: 132 - RNA, 20 nt, Artificial Sequence
  Description of Artificial Sequence: Synthetic oligonucleotide
cccaggagccagagcgggcc

SEQ ID NO: 133 - RNA, 20 nt, Artificial Sequence
  Description of Artificial Sequence: Synthetic oligonucleotide
cacuugcagcugauuggccg

SEQ ID NO: 134 - RNA, 20 nt, Artificial Sequence
  Description of Artificial Sequence: Synthetic oligonucleotide
uuucguugauaaaauucuga

SEQ ID NO: 135 - RNA, 20 nt, Artificial Sequence
  Description of Artificial Sequence: Synthetic oligonucleotide
cucaucuccaacuauaaagc

SEQ ID NO: 136 - RNA, 20 nt, Artificial Sequence
  Description of Artificial Sequence: Synthetic oligonucleotide
ggaaaggacuagaagccuca

SEQ ID NO: 137 - RNA, 20 nt, Artificial Sequence
  Description of Artificial Sequence: Synthetic oligonucleotide
ccuaccuucuguggagaaga

SEQ ID NO: 138 - RNA, 20 nt, Artificial Sequence
  Description of Artificial Sequence: Synthetic oligonucleotide
cucugaucaggauuuguugg

SEQ ID NO: 139 - RNA, 20 nt, Artificial Sequence
  Description of Artificial Sequence: Synthetic oligonucleotide
ccaucuccgacgugcccucc

SEQ ID NO: 140 - RNA, 20 nt, Artificial Sequence
  Description of Artificial Sequence: Synthetic oligonucleotide
cagcucagaggaucccgggc

SEQ ID NO: 141 - RNA, 20 nt, Artificial Sequence
  Description of Artificial Sequence: Synthetic oligonucleotide
cccagcaggcccagcagaag

SEQ ID NO: 142 - RNA, 20 nt, Artificial Sequence
  Description of Artificial Sequence: Synthetic oligonucleotide
uccagcaccgucacuccaga

SEQ ID NO: 143 - RNA, 20 nt, Artificial Sequence
  Description of Artificial Sequence: Synthetic oligonucleotide
acacguguuacacuuuugcu

SEQ ID NO: 144 - RNA, 20 nt, Artificial Sequence
  Description of Artificial Sequence: Synthetic oligonucleotide
gauucgcuugaccaguuggu

SEQ ID NO: 145 - RNA, 20 nt, Artificial Sequence
  Description of Artificial Sequence: Synthetic oligonucleotide
agaaacguggucagccacuc

SEQ ID NO: 146 - RNA, 20 nt, Artificial Sequence
  Description of Artificial Sequence: Synthetic oligonucleotide
cucuugcuguccacaucuuc

SEQ ID NO: 147 - RNA, 20 nt, Artificial Sequence
  Description of Artificial Sequence: Synthetic oligonucleotide
gcagaucaucaccacagccc

SEQ ID NO: 148 - RNA, 20 nt, Artificial Sequence
  Description of Artificial Sequence: Synthetic oligonucleotide
aggucuccgcagcacuucug

SEQ ID NO: 149 - RNA, 20 nt, Artificial Sequence
  Description of Artificial Sequence: Synthetic oligonucleotide
cuggcccagcgagccccugg

SEQ ID NO: 150 - RNA, 20 nt, Artificial Sequence
  Description of Artificial Sequence: Synthetic oligonucleotide
uaaccaccuccagagcuacu

SEQ ID NO: 151 - RNA, 20 nt, Artificial Sequence
  Description of Artificial Sequence: Synthetic oligonucleotide
augugaagcagcaaguagau

SEQ ID NO: 152 - RNA, 20 nt, Artificial Sequence
  Description of Artificial Sequence: Synthetic oligonucleotide
cuucuggggacaccugcugg

SEQ ID NO: 153 - RNA, 20 nt, Artificial Sequence
  Description of Artificial Sequence: Synthetic oligonucleotide
aacuuuggauuggggaaugu

SEQ ID NO: 154 - RNA, 20 nt, Artificial Sequence
  Description of Artificial Sequence: Synthetic oligonucleotide
caggagugagguuggggcuc

SEQ ID NO: 155 - RNA, 20 nt, Artificial Sequence
  Description of Artificial Sequence: Synthetic oligonucleotide
ggcauugcacucacgugagg

SEQ ID NO: 156 - RNA, 20 nt, Artificial Sequence
  Description of Artificial Sequence: Synthetic oligonucleotide
ccacagcaugaagaucuccg

SEQ ID NO: 157 - RNA, 20 nt, Artificial Sequence
  Description of Artificial Sequence: Synthetic oligonucleotide
ucccagagcuugaguuacca

SEQ ID NO: 158 - RNA, 20 nt, Artificial Sequence
  Description of Artificial Sequence: Synthetic oligonucleotide
caccauuugugaacugggcc

SEQ ID NO: 159 - RNA, 20 nt, Artificial Sequence
  Description of Artificial Sequence: Synthetic oligonucleotide
caccauuugugaacugggcc

SEQ ID NO: 160 - RNA, 20 nt, Artificial Sequence
  Description of Artificial Sequence: Synthetic oligonucleotide
ggacgugcuuacaugauugc

SEQ ID NO: 161 - RNA, 20 nt, Artificial Sequence
  Description of Artificial Sequence: Synthetic oligonucleotide
guugccaaggagacuagugg

SEQ ID NO: 162 - RNA, 20 nt, Artificial Sequence
  Description of Artificial Sequence: Synthetic oligonucleotide
uccuucagaaguuccugagu

SEQ ID NO: 163 - RNA, 20 nt, Artificial Sequence
  Description of Artificial Sequence: Synthetic oligonucleotide
gcuccucucccugcagcucg

SEQ ID NO: 164 - RNA, 20 nt, Artificial Sequence
  Description of Artificial Sequence: Synthetic oligonucleotide
uggcucccuugaaguacucc

SEQ ID NO: 165 - RNA, 20 nt, Artificial Sequence
  Description of Artificial Sequence: Synthetic oligonucleotide
uggagcaguccucagauguc

SEQ ID NO: 166 - RNA, 20 nt, Artificial Sequence
  Description of Artificial Sequence: Synthetic oligonucleotide
gaggcagcagagcucuuugu

SEQ ID NO: 167 - RNA, 20 nt, Artificial Sequence
  Description of Artificial Sequence: Synthetic oligonucleotide
uggcuuggggcacugggggc

SEQ ID NO: 168 - RNA, 20 nt, Artificial Sequence
  Description of Artificial Sequence: Synthetic oligonucleotide
ccauccucccucccgagggg

SEQ ID NO: 169 - RNA, 20 nt, Artificial Sequence
  Description of Artificial Sequence: Synthetic oligonucleotide
cccacaacucacacuacagc

SEQ ID NO: 170 - RNA, 20 nt, Artificial Sequence
  Description of Artificial Sequence: Synthetic oligonucleotide
aaguuccucacgauguaccc

SEQ ID NO: 171 - RNA, 20 nt, Artificial Sequence
  Description of Artificial Sequence: Synthetic oligonucleotide
cauuggugccacucagaguu

SEQ ID NO: 172 - RNA, 20 nt, Artificial Sequence
  Description of Artificial Sequence: Synthetic oligonucleotide
guuauaacagcaggugacug

SEQ ID NO: 173 - RNA, 20 nt, Artificial Sequence
  Description of Artificial Sequence: Synthetic oligonucleotide
uucuuugggacacuugcugc

SEQ ID NO: 174 - RNA, 20 nt, Artificial Sequence
  Description of Artificial Sequence: Synthetic oligonucleotide
ggcuugucccuugcuccaca

SEQ ID NO: 175 - RNA, 20 nt, Artificial Sequence
  Description of Artificial Sequence: Synthetic oligonucleotide
caaacucuugguacagcaca

SEQ ID NO: 176 - RNA, 20 nt, Artificial Sequence
  Description of Artificial Sequence: Synthetic oligonucleotide
caccucugcggcgaaucaga

SEQ ID NO: 177 - RNA, 20 nt, Artificial Sequence
  Description of Artificial Sequence: Synthetic oligonucleotide
caguugagcucaaggcuaaa

SEQ ID NO: 178 - RNA, 20 nt, Artificial Sequence
  Description of Artificial Sequence: Synthetic oligonucleotide
cccugcaggcagugauggag

SEQ ID NO: 179 - RNA, 20 nt, Artificial Sequence
  Description of Artificial Sequence: Synthetic oligonucleotide
ccucccugccuugguaccuu

SEQ ID NO: 180 - RNA, 20 nt, Artificial Sequence
  Description of Artificial Sequence: Synthetic oligonucleotide
ggcucugagccuccuuaucc

SEQ ID NO: 181 - RNA, 20 nt, Artificial Sequence
  Description of Artificial Sequence: Synthetic oligonucleotide
accccuccccuaggccccua

SEQ ID NO: 182 - RNA, 20 nt, Artificial Sequence
  Description of Artificial Sequence: Synthetic oligonucleotide
gacgguaacggacguaauca

SEQ ID NO: 183 - RNA, 20 nt, Artificial Sequence
  Description of Artificial Sequence: Synthetic oligonucleotide
aggccucgggcaggagucug

SEQ ID NO: 184 - RNA, 20 nt, Artificial Sequence
  Description of Artificial Sequence: Synthetic oligonucleotide
ucguuucaaaguaacucucc

SEQ ID NO: 185 - RNA, 20 nt, Artificial Sequence
  Description of Artificial Sequence: Synthetic oligonucleotide
agcagucagcacuaguagca

SEQ ID NO: 186 - RNA, 20 nt, Artificial Sequence
  Description of Artificial Sequence: Synthetic oligonucleotide
gugcucuggaggagaaagau

SEQ ID NO: 187 - RNA, 20 nt, Artificial Sequence
  Description of Artificial Sequence: Synthetic oligonucleotide
ccucaaggcaggagugaugu

SEQ ID NO: 188 - RNA, 20 nt, Artificial Sequence
  Description of Artificial Sequence: Synthetic oligonucleotide
gagaauuccugagaaccgag

SEQ ID NO: 189 - RNA, 20 nt, Artificial Sequence
  Description of Artificial Sequence: Synthetic oligonucleotide
cucuccucuucuaggcucug

SEQ ID NO: 190 - RNA, 20 nt, Artificial Sequence
  Description of Artificial Sequence: Synthetic oligonucleotide
ugugguugcaggugucuuug

SEQ ID NO: 191 - RNA, 20 nt, Artificial Sequence
  Description of Artificial Sequence: Synthetic oligonucleotide
gggcugugcuccggcgcgcc

SEQ ID NO: 192 - RNA, 20 nt, Artificial Sequence
  Description of Artificial Sequence: Synthetic oligonucleotide
ggccccacucacaucgcagc

SEQ ID NO: 193 - RNA, 20 nt, Artificial Sequence
  Description of Artificial Sequence: Synthetic oligonucleotide
ccauccuguugcaugacuga

SEQ ID NO: 194 - RNA, 20 nt, Artificial Sequence
  Description of Artificial Sequence: Synthetic oligonucleotide
ccaguaacagcugcucccag

SEQ ID NO: 195 - RNA, 20 nt, Artificial Sequence
  Description of Artificial Sequence: Synthetic oligonucleotide
guauuggaagcagcaggucu

SEQ ID NO: 196 - RNA, 20 nt, Artificial Sequence
  Description of Artificial Sequence: Synthetic oligonucleotide
gagcucacacgaaagccugg

SEQ ID NO: 197 - RNA, 20 nt, Artificial Sequence
  Description of Artificial Sequence: Synthetic oligonucleotide
acugaggaaggucauccagg

SEQ ID NO: 198 - RNA, 20 nt, Artificial Sequence
  Description of Artificial Sequence: Synthetic oligonucleotide
aggcagugcuggguggcagu

SEQ ID NO: 199 - RNA, 20 nt, Artificial Sequence
  Description of Artificial Sequence: Synthetic oligonucleotide
aauccuuccagcacagauuu

SEQ ID NO: 200 - RNA, 20 nt, Artificial Sequence
  Description of Artificial Sequence: Synthetic oligonucleotide
gugcccccacucaccuucug

SEQ ID NO: 201 - RNA, 20 nt, Artificial Sequence
  Description of Artificial Sequence: Synthetic oligonucleotide
caggcaggaaugcagcagag

SEQ ID NO: 202 - RNA, 20 nt, Artificial Sequence
  Description of Artificial Sequence: Synthetic oligonucleotide
gccacaagaaaagauugaug

SEQ ID NO: 203 - RNA, 20 nt, Artificial Sequence
  Description of Artificial Sequence: Synthetic oligonucleotide
acucacgugaugcagagaac

SEQ ID NO: 204 - RNA, 20 nt, Artificial Sequence
  Description of Artificial Sequence: Synthetic oligonucleotide
ucaccugcucagaaucaugc

SEQ ID NO: 205 - RNA, 20 nt, Artificial Sequence
  Description of Artificial Sequence: Synthetic oligonucleotide
ugagagcgcuggagagcaga

SEQ ID NO: 206 - RNA, 20 nt, Artificial Sequence
  Description of Artificial Sequence: Synthetic oligonucleotide
ugagagcgcuggagagcaga

SEQ ID NO: 207 - RNA, 20 nt, Artificial Sequence
  Description of Artificial Sequence: Synthetic oligonucleotide
ugagagcgcuggagagcaga

SEQ ID NO: 208 - RNA, 20 nt, Artificial Sequence
  Description of Artificial Sequence: Synthetic oligonucleotide
gacucacacgacugcugggu

SEQ ID NO: 209 - RNA, 20 nt, Artificial Sequence
  Description of Artificial Sequence: Synthetic oligonucleotide
ugaugugggcacggggcagu

SEQ ID NO: 210 - RNA, 20 nt, Artificial Sequence
  Description of Artificial Sequence: Synthetic oligonucleotide
cuuuccucuuccagauuccu

SEQ ID NO: 211 - RNA, 20 nt, Artificial Sequence
  Description of Artificial Sequence: Synthetic oligonucleotide
auugauaaaucuguagcagc

SEQ ID NO: 212 - RNA, 20 nt, Artificial Sequence
  Description of Artificial Sequence: Synthetic oligonucleotide
ccacauacauuacagcuucc

SEQ ID NO: 213 - RNA, 20 nt, Artificial Sequence
  Description of Artificial Sequence: Synthetic oligonucleotide
cuaguccuauucccugccca

SEQ ID NO: 214 - RNA, 20 nt, Artificial Sequence
  Description of Artificial Sequence: Synthetic oligonucleotide
aaagcagcaggugauuggaa

SEQ ID NO: 215 - RNA, 20 nt, Artificial Sequence
  Description of Artificial Sequence: Synthetic oligonucleotide
caccaacauccaauguccca

SEQ ID NO: 216 - RNA, 20 nt, Artificial Sequence
  Description of Artificial Sequence: Synthetic oligonucleotide
cccccauucaaaaguucuga

SEQ ID NO: 217 - RNA, 20 nt, Artificial Sequence
  Description of Artificial Sequence: Synthetic oligonucleotide
ccugguuggaaacauccugg

SEQ ID NO: 218 - RNA, 20 nt, Artificial Sequence
  Description of Artificial Sequence: Synthetic oligonucleotide
aggcccucucguucaccuuc

SEQ ID NO: 219 - RNA, 20 nt, Artificial Sequence
  Description of Artificial Sequence: Synthetic oligonucleotide
ucauaguccucugugguguu

SEQ ID NO: 220 - RNA, 20 nt, Artificial Sequence
  Description of Artificial Sequence: Synthetic oligonucleotide
gauaaaccgagaacgagaug

SEQ ID NO: 221 - RNA, 20 nt, Artificial Sequence
  Description of Artificial Sequence: Synthetic oligonucleotide
accuuuuuugauuaugauua

SEQ ID NO: 222 - RNA, 20 nt, Artificial Sequence
  Description of Artificial Sequence: Synthetic oligonucleotide
guagagcggaggcaggaguu

SEQ ID NO: 223 - RNA, 20 nt, Artificial Sequence
  Description of Artificial Sequence: Synthetic oligonucleotide
cuagauacaguugagaccuu

SEQ ID NO: 224 - RNA, 20 nt, Artificial Sequence
  Description of Artificial Sequence: Synthetic oligonucleotide
uaucagcuuuuucacagagc

SEQ ID NO: 225 - RNA, 20 nt, Artificial Sequence
  Description of Artificial Sequence: Synthetic oligonucleotide
gguguucacugugggccucu

SEQ ID NO: 226 - RNA, 20 nt, Artificial Sequence
  Description of Artificial Sequence: Synthetic oligonucleotide
uuuugcaguuuaucaggaug

SEQ ID NO: 227 - RNA, 20 nt, Artificial Sequence
  Description of Artificial Sequence: Synthetic oligonucleotide
aaaacaggucagagauggcc

SEQ ID NO: 228 - RNA, 20 nt, Artificial Sequence
  Description of Artificial Sequence: Synthetic oligonucleotide
uguauuuccaaagucccacu

SEQ ID NO: 229 - RNA, 20 nt, Artificial Sequence
  Description of Artificial Sequence: Synthetic oligonucleotide
uuguucuuacucucccauuc

SEQ ID NO: 230 - RNA, 20 nt, Artificial Sequence
  Description of Artificial Sequence: Synthetic oligonucleotide
gccuuuuagcaacuugcacg

SEQ ID NO: 231 - RNA, 20 nt, Artificial Sequence
  Description of Artificial Sequence: Synthetic oligonucleotide
ccgguacaucgccauuguac

SEQ ID NO: 232 - RNA, 20 nt, Artificial Sequence
  Description of Artificial Sequence: Synthetic oligonucleotide
ggccgcgcuguaggcccaga

SEQ ID NO: 233 - RNA, 20 nt, Artificial Sequence
  Description of Artificial Sequence: Synthetic oligonucleotide
gagcagguagguaucgguca

SEQ ID NO: 234 - RNA, 20 nt, Artificial Sequence
  Description of Artificial Sequence: Synthetic oligonucleotide
uaggcccacgaaacaaauga

SEQ ID NO: 235 - RNA, 20 nt, Artificial Sequence
  Description of Artificial Sequence: Synthetic oligonucleotide
uccgggccugaugaucccug

SEQ ID NO: 236 - RNA, 20 nt, Artificial Sequence
  Description of Artificial Sequence: Synthetic oligonucleotide
gccuucacagucaccuguga

SEQ ID NO: 237 - RNA, 20 nt, Artificial Sequence
  Description of Artificial Sequence: Synthetic oligonucleotide
caaagacuccuucugcuucc

SEQ ID NO: 238 - RNA, 20 nt, Artificial Sequence
  Description of Artificial Sequence: Synthetic oligonucleotide
ccuucacgaggaauguuccu

SEQ ID NO: 239 - RNA, 20 nt, Artificial Sequence
  Description of Artificial Sequence: Synthetic oligonucleotide
uccuucacgaggaauguucc

SEQ ID NO: 240 - RNA, 20 nt, Artificial Sequence
  Description of Artificial Sequence: Synthetic oligonucleotide
gcuggucacaguccuucacg

SEQ ID NO: 241 - RNA, 20 nt, Artificial Sequence
  Description of Artificial Sequence: Synthetic oligonucleotide
acugagcagccuuucuaugc

SEQ ID NO: 242 - RNA, 20 nt, Artificial Sequence
  Description of Artificial Sequence: Synthetic oligonucleotide
caccaaaaucuuguuuccug

SEQ ID NO: 243 - RNA, 20 nt, Artificial Sequence
  Description of Artificial Sequence: Synthetic oligonucleotide
ucaccaaaaucuuguuuccu

SEQ ID NO: 244 - RNA, 20 nt, Artificial Sequence
  Description of Artificial Sequence: Synthetic oligonucleotide
uugucguacgcuacaagcau

SEQ ID NO: 245 - RNA, 20 nt, Artificial Sequence
  Description of Artificial Sequence: Synthetic oligonucleotide
auugucguacgcuacaagca

SEQ ID NO: 246 - RNA, 20 nt, Artificial Sequence
  Description of Artificial Sequence: Synthetic oligonucleotide
caagaaaaaugggcugugac

SEQ ID NO: 247 - RNA, 20 nt, Artificial Sequence
  Description of Artificial Sequence: Synthetic oligonucleotide
ggugcuguccuggcuguguu

SEQ ID NO: 248 - RNA, 20 nt, Artificial Sequence
  Description of Artificial Sequence: Synthetic oligonucleotide
uauccagaagacaauuaaaa

SEQ ID NO: 249 - RNA, 20 nt, Artificial Sequence
  Description of Artificial Sequence: Synthetic oligonucleotide
agugcaauguaggaguccaa

SEQ ID NO: 250 - RNA, 20 nt, Artificial Sequence
  Description of Artificial Sequence: Synthetic oligonucleotide
cuggagcuccagcugagaca

SEQ ID NO: 251 - RNA, 20 nt, Artificial Sequence
  Description of Artificial Sequence: Synthetic oligonucleotide
uuuugaacuccaccuucuuc

SEQ ID NO: 252 - RNA, 20 nt, Artificial Sequence
  Description of Artificial Sequence: Synthetic oligonucleotide
caaaauagauagaagaugaa

SEQ ID NO: 253 - RNA, 20 nt, Artificial Sequence
  Description of Artificial Sequence: Synthetic oligonucleotide
acgauacagagaugcaacac

SEQ ID NO: 254 - RNA, 20 nt, Artificial Sequence
  Description of Artificial Sequence: Synthetic oligonucleotide
ccaguuugaaggcuuuguga

SEQ ID NO: 255 - RNA, 20 nt, Artificial Sequence
  Description of Artificial Sequence: Synthetic oligonucleotide
agcgcuggaugcacaccacg

SEQ ID NO: 256 - RNA, 20 nt, Artificial Sequence
  Description of Artificial Sequence: Synthetic oligonucleotide
agcccgcaggacgcacccau

SEQ ID NO: 257 - RNA, 20 nt, Artificial Sequence
  Description of Artificial Sequence: Synthetic oligonucleotide
cgccgcggcgaugccggagg

SEQ ID NO: 258 - RNA, 20 nt, Artificial Sequence
  Description of Artificial Sequence: Synthetic oligonucleotide
ugcucacacauaccucuccg

SEQ ID NO: 259 - RNA, 20 nt, Artificial Sequence
  Description of Artificial Sequence: Synthetic oligonucleotide
uguuggagauaaggucgcgc

SEQ ID NO: 260 - RNA, 20 nt, Artificial Sequence
  Description of Artificial Sequence: Synthetic oligonucleotide
agaugcacaggaggagaagc

SEQ ID NO: 261 - RNA, 20 nt, Artificial Sequence
  Description of Artificial Sequence: Synthetic oligonucleotide
ccggaacuggcucggccugg

SEQ ID NO: 262 - RNA, 20 nt, Artificial Sequence
  Description of Artificial Sequence: Synthetic oligonucleotide
cacccggaacuggcucggcc

SEQ ID NO: 263 - RNA, 20 nt, Artificial Sequence
  Description of Artificial Sequence: Synthetic oligonucleotide
ggcgacacccggaacuggcu

SEQ ID NO: 264 - RNA, 20 nt, Artificial Sequence
  Description of Artificial Sequence: Synthetic oligonucleotide
cgccaggccgagccaguucc

SEQ ID NO: 265 - RNA, 20 nt, Artificial Sequence
  Description of Artificial Sequence: Synthetic oligonucleotide
ggcacugcgacaaacagauc

SEQ ID NO: 266 - RNA, 20 nt, Artificial Sequence
  Description of Artificial Sequence: Synthetic oligonucleotide
aaagagaacucugauucugg

SEQ ID NO: 267 - RNA, 20 nt, Artificial Sequence
  Description of Artificial Sequence: Synthetic oligonucleotide
cugcugguacuccugccucu

SEQ ID NO: 268 - RNA, 20 nt, Artificial Sequence
  Description of Artificial Sequence: Synthetic oligonucleotide
gccggcggggccgggaggcu

SEQ ID NO: 269 - RNA, 20 nt, Artificial Sequence
  Description of Artificial Sequence: Synthetic oligonucleotide
ucccggccggcccgcggcgc

SEQ ID NO: 270 - RNA, 20 nt, Artificial Sequence
  Description of Artificial Sequence: Synthetic oligonucleotide
cugcccguucggggagcggc

SEQ ID NO: 271 - RNA, 20 nt, Artificial Sequence
  Description of Artificial Sequence: Synthetic oligonucleotide
gugauaacaauauaugguuc

SEQ ID NO: 272 - RNA, 20 nt, Artificial Sequence
  Description of Artificial Sequence: Synthetic oligonucleotide
gacuugaucgauuaaugaag

SEQ ID NO: 273 - RNA, 20 nt, Artificial Sequence
  Description of Artificial Sequence: Synthetic oligonucleotide
guaggaaaaaguaaaauuua

SEQ ID NO: 274 - RNA, 20 nt, Artificial Sequence
  Description of Artificial Sequence: Synthetic oligonucleotide
cauaggucccagccaagcug

SEQ ID NO: 275 - RNA, 20 nt, Artificial Sequence
  Description of Artificial Sequence: Synthetic oligonucleotide
cauagguuuucuggauggag

SEQ ID NO: 276 - RNA, 20 nt, Artificial Sequence
  Description of Artificial Sequence: Synthetic oligonucleotide
ggugccagagcaccgugcac

SEQ ID NO: 277 - RNA, 20 nt, Artificial Sequence
  Description of Artificial Sequence: Synthetic oligonucleotide
gacucagguuuggcguguuc

SEQ ID NO: 278 - RNA, 20 nt, Artificial Sequence
  Description of Artificial Sequence: Synthetic oligonucleotide
uacgcugccgcuacuugcca

SEQ ID NO: 279 - RNA, 20 nt, Artificial Sequence
  Description of Artificial Sequence: Synthetic oligonucleotide
ugcggggugcuuccggggug

SEQ ID NO: 280 - RNA, 20 nt, Artificial Sequence
  Description of Artificial Sequence: Synthetic oligonucleotide
cgagucagucauggcaccua

SEQ ID NO: 281 - RNA, 20 nt, Artificial Sequence
  Description of Artificial Sequence: Synthetic oligonucleotide
uccacccggggccaaacccg

SEQ ID NO: 282 - RNA, 20 nt, Artificial Sequence
  Description of Artificial Sequence: Synthetic oligonucleotide
aaaggcggugcaggaccaua

SEQ ID NO: 283 - RNA, 20 nt, Artificial Sequence
  Description of Artificial Sequence: Synthetic oligonucleotide
ccggaccccgagccugccgg

SEQ ID NO: 284 - RNA, 20 nt, Artificial Sequence
  Description of Artificial Sequence: Synthetic oligonucleotide
ggaaagcccgcgccggcagc

SEQ ID NO: 285 - RNA, 20 nt, Artificial Sequence
  Description of Artificial Sequence: Synthetic oligonucleotide
ucccgccgcacucaccgacu

SEQ ID NO: 286 - RNA, 20 nt, Artificial Sequence
  Description of Artificial Sequence: Synthetic oligonucleotide
ccgcccggcaccuaccacuu

SEQ ID NO: 287 - RNA, 20 nt, Artificial Sequence
  Description of Artificial Sequence: Synthetic oligonucleotide
gguagucggggucgcagcgc

SEQ ID NO: 288 - RNA, 20 nt, Artificial Sequence
  Description of Artificial Sequence: Synthetic oligonucleotide
gcugcuggcgcccgagauca

SEQ ID NO: 289 - RNA, 20 nt, Artificial Sequence
  Description of Artificial Sequence: Synthetic oligonucleotide
gcucagugcucgagaucgcc

SEQ ID NO: 290 - RNA, 20 nt, Artificial Sequence
  Description of Artificial Sequence: Synthetic oligonucleotide
ccagggcuucgcgguggaca

SEQ ID NO: 291 - RNA, 20 nt, Artificial Sequence
  Description of Artificial Sequence: Synthetic oligonucleotide
uuaccagcucgguuuccagc

SEQ ID NO: 292 - RNA, 20 nt, Artificial Sequence
  Description of Artificial Sequence: Synthetic oligonucleotide
uugagaacgcgccggagcaa

SEQ ID NO: 293 - RNA, 20 nt, Artificial Sequence
  Description of Artificial Sequence: Synthetic oligonucleotide
cgcuccgggggccucuggcg

SEQ ID NO: 294 - RNA, 20 nt, Artificial Sequence
  Description of Artificial Sequence: Synthetic oligonucleotide
cggcccgaggcgauggagaa

SEQ ID NO: 295 - RNA, 20 nt, Artificial Sequence
  Description of Artificial Sequence: Synthetic oligonucleotide
ggagcuccgcacacagauga

SEQ ID NO: 296 - RNA, 20 nt, Artificial Sequence
  Description of Artificial Sequence: Synthetic oligonucleotide
aaugauccucgccuuuuacc

SEQ ID NO: 297 - RNA, 20 nt, Artificial Sequence
  Description of Artificial Sequence: Synthetic oligonucleotide
cgacaggggccagcugauac

SEQ ID NO: 298 - RNA, 20 nt, Artificial Sequence
  Description of Artificial Sequence: Synthetic oligonucleotide
gugugcgagcgggcgcgcug

SEQ ID NO: 299 - RNA, 20 nt, Artificial Sequence
  Description of Artificial Sequence: Synthetic oligonucleotide
cagcagcuucgccuacgacc

SEQ ID NO: 300 - RNA, 20 nt, Artificial Sequence
  Description of Artificial Sequence: Synthetic oligonucleotide
cccgucggcacucacgaucu

SEQ ID NO: 301 - RNA, 20 nt, Artificial Sequence
  Description of Artificial Sequence: Synthetic oligonucleotide
aucaaccuggacucugcgga

SEQ ID NO: 302 - RNA, 20 nt, Artificial Sequence
  Description of Artificial Sequence: Synthetic oligonucleotide
ggaagguacgauaagcuuga

SEQ ID NO: 303 - RNA, 20 nt, Artificial Sequence
  Description of Artificial Sequence: Synthetic oligonucleotide
gugcauuuuaccccaaccga

SEQ ID NO: 304 - RNA, 20 nt, Artificial Sequence
  Description of Artificial Sequence: Synthetic oligonucleotide
ccagcugagagccguugagc

SEQ ID NO: 305 - RNA, 20 nt, Artificial Sequence
  Description of Artificial Sequence: Synthetic oligonucleotide
gggaugcugcggugacgugg

SEQ ID NO: 306 - RNA, 20 nt, Artificial Sequence
  Description of Artificial Sequence: Synthetic oligonucleotide
caggcgcucguacugcacau

SEQ ID NO: 307 - RNA, 20 nt, Artificial Sequence
  Description of Artificial Sequence: Synthetic oligonucleotide
uaguccagggcuucgccgcc

SEQ ID NO: 308 - RNA, 20 nt, Artificial Sequence
  Description of Artificial Sequence: Synthetic oligonucleotide
cugagcuuccugcauguugu

SEQ ID NO: 309 - RNA, 20 nt, Artificial Sequence
  Description of Artificial Sequence: Synthetic oligonucleotide
ccucggcgauggcggcgucc

SEQ ID NO: 310 - RNA, 20 nt, Artificial Sequence
  Description of Artificial Sequence: Synthetic oligonucleotide
ccagcgugaguacaucggag

SEQ ID NO: 311 - RNA, 20 nt, Artificial Sequence
  Description of Artificial Sequence: Synthetic oligonucleotide
cauagggcguaaagagagcc

SEQ ID NO: 312 - RNA, 20 nt, Artificial Sequence
  Description of Artificial Sequence: Synthetic oligonucleotide
acuccucacauguguugucc

SEQ ID NO: 313 - RNA, 20 nt, Artificial Sequence
  Description of Artificial Sequence: Synthetic oligonucleotide
gccuucuuaagguagcacac

SEQ ID NO: 314 - RNA, 20 nt, Artificial Sequence
  Description of Artificial Sequence: Synthetic oligonucleotide
gguguuaucucugaagcgca

SEQ ID NO: 315 - RNA, 20 nt, Artificial Sequence
  Description of Artificial Sequence: Synthetic oligonucleotide
gucaugcucuucauaauccu

SEQ ID NO: 316 - RNA, 20 nt, Artificial Sequence
  Description of Artificial Sequence: Synthetic oligonucleotide
caccuuucugcacuuucagc

SEQ ID NO: 317 - RNA, 20 nt, Artificial Sequence
  Description of Artificial Sequence: Synthetic oligonucleotide
caaugcagugcccugauggg

SEQ ID NO: 318 - RNA, 20 nt, Artificial Sequence
  Description of Artificial Sequence: Synthetic oligonucleotide
ccagggcgagaaggaguagu

SEQ ID NO: 319 - RNA, 20 nt, Artificial Sequence
  Description of Artificial Sequence: Synthetic oligonucleotide
ccacagugcccaagagcagc

SEQ ID NO: 320 - RNA, 20 nt, Artificial Sequence
  Description of Artificial Sequence: Synthetic oligonucleotide
cagggcugcgugcuggggcu

SEQ ID NO: 321 - RNA, 20 nt, Artificial Sequence
  Description of Artificial Sequence: Synthetic oligonucleotide
uagagacacugcugcugaga

SEQ ID NO: 322 - RNA, 20 nt, Artificial Sequence
  Description of Artificial Sequence: Synthetic oligonucleotide
ugugccacagcagcagcugc

SEQ ID NO: 323 - RNA, 20 nt, Artificial Sequence
  Description of Artificial Sequence: Synthetic oligonucleotide
gaagcucuggggcagggagc

SEQ ID NO: 324 - RNA, 20 nt, Artificial Sequence
  Description of Artificial Sequence: Synthetic oligonucleotide
gggcgauggcgcagcgcucc

SEQ ID NO: 325 - RNA, 20 nt, Artificial Sequence
  Description of Artificial Sequence: Synthetic oligonucleotide
gcaauagcaacaagaccugg

SEQ ID NO: 326 - RNA, 20 nt, Artificial Sequence
  Description of Artificial Sequence: Synthetic oligonucleotide
auagcccugaggccauggau

SEQ ID NO: 327 - RNA, 20 nt, Artificial Sequence
  Description of Artificial Sequence: Synthetic oligonucleotide
gcauggagucuggucagagc

SEQ ID NO: 328 - RNA, 20 nt, Artificial Sequence
  Description of Artificial Sequence: Synthetic oligonucleotide
ucuccgcaggugcagcucca

SEQ ID NO: 329 - RNA, 20 nt, Artificial Sequence
  Description of Artificial Sequence: Synthetic oligonucleotide
ccggccaccggcagccgcgg

SEQ ID NO: 330 - RNA, 20 nt, Artificial Sequence
  Description of Artificial Sequence: Synthetic oligonucleotide
agccgcagccgcucgugcac

SEQ ID NO: 331 - RNA, 20 nt, Artificial Sequence
  Description of Artificial Sequence: Synthetic oligonucleotide
gugccgacccgaaggagcaa

SEQ ID NO: 332 - RNA, 20 nt, Artificial Sequence
  Description of Artificial Sequence: Synthetic oligonucleotide
cuucgagaagcagaucggcg

SEQ ID NO: 333 - RNA, 20 nt, Artificial Sequence
  Description of Artificial Sequence: Synthetic oligonucleotide
cgccuguggcuucgggcucc

SEQ ID NO: 334 - RNA, 20 nt, Artificial Sequence
  Description of Artificial Sequence: Synthetic oligonucleotide
cuaccaacaaauuucccacc

SEQ ID NO: 335 - RNA, 20 nt, Artificial Sequence
  Description of Artificial Sequence: Synthetic oligonucleotide
uuggggacaucguggucuuu

SEQ ID NO: 336 - RNA, 20 nt, Artificial Sequence
  Description of Artificial Sequence: Synthetic oligonucleotide
aaguuuucugucacugauuc

SEQ ID NO: 337 - RNA, 20 nt, Artificial Sequence
  Description of Artificial Sequence: Synthetic oligonucleotide
ggagagagcagcgcgggcca

SEQ ID NO: 338 - RNA, 20 nt, Artificial Sequence
  Description of Artificial Sequence: Synthetic oligonucleotide
cuggccggcgcgcagcaggu

SEQ ID NO: 339 - RNA, 20 nt, Artificial Sequence
  Description of Artificial Sequence: Synthetic oligonucleotide
gugccuaccccagccgcguc

SEQ ID NO: 340 - RNA, 20 nt, Artificial Sequence
  Description of Artificial Sequence: Synthetic oligonucleotide
uacaguauauaauuacaacc

SEQ ID NO: 341 - RNA, 20 nt, Artificial Sequence
  Description of Artificial Sequence: Synthetic oligonucleotide
cguggacaaaauuggcuugc

SEQ ID NO: 342 - RNA, 20 nt, Artificial Sequence
  Description of Artificial Sequence: Synthetic oligonucleotide
uugauuacuaaugcugaugc

SEQ ID NO: 343 - RNA, 20 nt, Artificial Sequence
  Description of Artificial Sequence: Synthetic oligonucleotide
gcugaagaugacaauggugc

SEQ ID NO: 344 - RNA, 20 nt, Artificial Sequence
  Description of Artificial Sequence: Synthetic oligonucleotide
guuguuacuuggguacauua

SEQ ID NO: 345 - RNA, 20 nt, Artificial Sequence
  Description of Artificial Sequence: Synthetic oligonucleotide
agcguccucuuuugaacaug

SEQ ID NO: 346 - RNA, 20 nt, Artificial Sequence
  Description of Artificial Sequence: Synthetic oligonucleotide
cuacaccuuuaauaagacuc

SEQ ID NO: 347 - RNA, 20 nt, Artificial Sequence
  Description of Artificial Sequence: Synthetic oligonucleotide
ucaagacuuacacaaucuga

SEQ ID NO: 348 - RNA, 20 nt, Artificial Sequence
  Description of Artificial Sequence: Synthetic oligonucleotide
ugacguuggcucuggcaaca

SEQ ID NO: 349 - RNA, 20 nt, Artificial Sequence
  Description of Artificial Sequence: Synthetic oligonucleotide
aggucuauuacacaagcuug

SEQ ID NO: 350 - RNA, 20 nt, Artificial Sequence
  Description of Artificial Sequence: Synthetic oligonucleotide
uucgaucaaugaagcgucua

SEQ ID NO: 351 - RNA, 20 nt, Artificial Sequence
  Description of Artificial Sequence: Synthetic oligonucleotide
acuuacaugauuucuuuucu

SEQ ID NO: 352 - RNA, 20 nt, Artificial Sequence
  Description of Artificial Sequence: Synthetic oligonucleotide
aauuggcgcuuggguucccc

SEQ ID NO: 353 - RNA, 20 nt, Artificial Sequence
  Description of Artificial Sequence: Synthetic oligonucleotide
cuguacaccgcgcgugugga

SEQ ID NO: 354 - RNA, 20 nt, Artificial Sequence
  Description of Artificial Sequence: Synthetic oligonucleotide
gaggggcgcggcgugggagc

SEQ ID NO: 355 - RNA, 20 nt, Artificial Sequence
  Description of Artificial Sequence: Synthetic oligonucleotide
gcgcugaguggacugcaagg

SEQ ID NO: 356 - RNA, 20 nt, Artificial Sequence
  Description of Artificial Sequence: Synthetic oligonucleotide
uaccagccccccaauuucuc

SEQ ID NO: 357 - RNA, 20 nt, Artificial Sequence
  Description of Artificial Sequence: Synthetic oligonucleotide
aauguggacaugcuuacucg

SEQ ID NO: 358 - RNA, 20 nt, Artificial Sequence
  Description of Artificial Sequence: Synthetic oligonucleotide
auuggucucagaggggccca

SEQ ID NO: 359 - RNA, 20 nt, Artificial Sequence
  Description of Artificial Sequence: Synthetic oligonucleotide
gaccuuugcacucacauucu

SEQ ID NO: 360 - RNA, 20 nt, Artificial Sequence
  Description of Artificial Sequence: Synthetic oligonucleotide
cuuccgacaggggucgccag

SEQ ID NO: 361 - RNA, 20 nt, Artificial Sequence
  Description of Artificial Sequence: Synthetic oligonucleotide
gcaguggcagcggcagcgau

SEQ ID NO: 362 - RNA, 20 nt, Artificial Sequence
  Description of Artificial Sequence: Synthetic oligonucleotide
uucuucccuaggagcgcccc

SEQ ID NO: 363 - RNA, 20 nt, Artificial Sequence
  Description of Artificial Sequence: Synthetic oligonucleotide
uucuucccuaggagcgcccc

SEQ ID NO: 364 - RNA, 20 nt, Artificial Sequence
  Description of Artificial Sequence: Synthetic oligonucleotide
uggcagcggaagcgcggggc

SEQ ID NO: 365 - RNA, 20 nt, Artificial Sequence
  Description of Artificial Sequence: Synthetic oligonucleotide
gggaccuuacauucacacuu

SEQ ID NO: 366 - RNA, 20 nt, Artificial Sequence
  Description of Artificial Sequence: Synthetic oligonucleotide
gggaccuuacauucacacuu

SEQ ID NO: 367 - RNA, 20 nt, Artificial Sequence
  Description of Artificial Sequence: Synthetic oligonucleotide
cccuuuauagggcagguugc

SEQ ID NO: 368 - RNA, 20 nt, Artificial Sequence
  Description of Artificial Sequence: Synthetic oligonucleotide
gcgccaugcgcucucaccgc

SEQ ID NO: 369 - RNA, 20 nt, Artificial Sequence
  Description of Artificial Sequence: Synthetic oligonucleotide
gagcuccuugugcgcgcugu

SEQ ID NO: 370 - RNA, 20 nt, Artificial Sequence
  Description of Artificial Sequence: Synthetic oligonucleotide
gcccgaaggacccgggacac

SEQ ID NO: 371 - RNA, 20 nt, Artificial Sequence
  Description of Artificial Sequence: Synthetic oligonucleotide
ggggccccggcggcgucagc

SEQ ID NO: 372 - RNA, 20 nt, Artificial Sequence
  Description of Artificial Sequence: Synthetic oligonucleotide
uuuuuauagggcagguugcu

SEQ ID NO: 373 - RNA, 20 nt, Artificial Sequence
  Description of Artificial Sequence: Synthetic oligonucleotide
caacaggugcaguuuugcca

SEQ ID NO: 374 - RNA, 20 nt, Artificial Sequence
  Description of Artificial Sequence: Synthetic oligonucleotide
aaauuugggguggaaagguu

SEQ ID NO: 375 - RNA, 20 nt, Artificial Sequence
  Description of Artificial Sequence: Synthetic oligonucleotide
uacuuacauaauuucugugu

SEQ ID NO: 376 - RNA, 20 nt, Artificial Sequence
  Description of Artificial Sequence: Synthetic oligonucleotide
uuucaauuuucucgcaggaa

SEQ ID NO: 377 - RNA, 20 nt, Artificial Sequence
  Description of Artificial Sequence: Synthetic oligonucleotide
auuguagguggauagucccu

SEQ ID NO: 378 - RNA, 20 nt, Artificial Sequence
  Description of Artificial Sequence: Synthetic oligonucleotide
ggaaccccaguagugagaaa

SEQ ID NO: 379 - RNA, 20 nt, Artificial Sequence
  Description of Artificial Sequence: Synthetic oligonucleotide
gaugguaagccuggcggaaa

SEQ ID NO: 380 - RNA, 20 nt, Artificial Sequence
  Description of Artificial Sequence: Synthetic oligonucleotide
uuggucaaguuuguuugucu

SEQ ID NO: 381 - RNA, 20 nt, Artificial Sequence
  Description of Artificial Sequence: Synthetic oligonucleotide
cuacaguggcauccugcugu

SEQ ID NO: 382 - RNA, 20 nt, Artificial Sequence
  Description of Artificial Sequence: Synthetic oligonucleotide
gugacagcuuugaagauuuc

SEQ ID NO: 383 - RNA, 20 nt, Artificial Sequence
  Description of Artificial Sequence: Synthetic oligonucleotide
aucuaguagaaaagggggca

SEQ ID NO: 384 - RNA, 20 nt, Artificial Sequence
  Description of Artificial Sequence: Synthetic oligonucleotide
uguggucauuaucuaugccc

SEQ ID NO: 385 - RNA, 20 nt, Artificial Sequence
  Description of Artificial Sequence: Synthetic oligonucleotide
gcagaaagaggaggcuguag

SEQ ID NO: 386 - RNA, 20 nt, Artificial Sequence
  Description of Artificial Sequence: Synthetic oligonucleotide
uaccuccccgcccugcccac

SEQ ID NO: 387 - RNA, 20 nt, Artificial Sequence
  Description of Artificial Sequence: Synthetic oligonucleotide
aagagcugaaguucuccagg

SEQ ID NO: 388 - RNA, 20 nt, Artificial Sequence
  Description of Artificial Sequence: Synthetic oligonucleotide
cccaaaguaccaguuugcca

SEQ ID NO: 389 - RNA, 20 nt, Artificial Sequence
  Description of Artificial Sequence: Synthetic oligonucleotide
agaggaggucggccacugac

SEQ ID NO: 390 - RNA, 20 nt, Artificial Sequence
  Description of Artificial Sequence: Synthetic oligonucleotide
uggauuggucauccugguca

SEQ ID NO: 391 - RNA, 20 nt, Artificial Sequence
  Description of Artificial Sequence: Synthetic oligonucleotide
ggaagucuugaugcuccucc

SEQ ID NO: 392 - RNA, 20 nt, Artificial Sequence
  Description of Artificial Sequence: Synthetic oligonucleotide
gguguuugucuguggucugg

SEQ ID NO: 393 - RNA, 20 nt, Artificial Sequence
  Description of Artificial Sequence: Synthetic oligonucleotide
ccgucaggcucugcaacuua

SEQ ID NO: 394 - RNA, 20 nt, Artificial Sequence
  Description of Artificial Sequence: Synthetic oligonucleotide
cacccugugcaggcucggca

SEQ ID NO: 395 - RNA, 20 nt, Artificial Sequence
  Description of Artificial Sequence: Synthetic oligonucleotide
ggauguccagcuguucucca

SEQ ID NO: 396 - RNA, 20 nt, Artificial Sequence
  Description of Artificial Sequence: Synthetic oligonucleotide
agcugcugcuggagccccag

SEQ ID NO: 397 - RNA, 20 nt, Artificial Sequence
  Description of Artificial Sequence: Synthetic oligonucleotide
uuucucuccccagcagucuu

SEQ ID NO: 398 - RNA, 20 nt, Artificial Sequence
  Description of Artificial Sequence: Synthetic oligonucleotide
ccacucccaguccacccugg

SEQ ID NO: 399 - RNA, 20 nt, Artificial Sequence
  Description of Artificial Sequence: Synthetic oligonucleotide
ucugccaccuggacaucauu

SEQ ID NO: 400 - RNA, 20 nt, Artificial Sequence
  Description of Artificial Sequence: Synthetic oligonucleotide
cacaaucuccgaggccagcg

SEQ ID NO: 401 - RNA, 20 nt, Artificial Sequence
  Description of Artificial Sequence: Synthetic oligonucleotide
gugucccugcagcugcgcgg

SEQ ID NO: 402 - RNA, 20 nt, Artificial Sequence
  Description of Artificial Sequence: Synthetic oligonucleotide
gcggccgacaugacgaaguu

SEQ ID NO: 403 - RNA, 20 nt, Artificial Sequence
  Description of Artificial Sequence: Synthetic oligonucleotide
ccgggccacucggccgggua

SEQ ID NO: 404 - RNA, 20 nt, Artificial Sequence
  Description of Artificial Sequence: Synthetic oligonucleotide
cgccuuccaaguggcagccc

SEQ ID NO: 405 - RNA, 20 nt, Artificial Sequence
  Description of Artificial Sequence: Synthetic oligonucleotide
cgugcggcccauguccuggc

SEQ ID NO: 406 - RNA, 20 nt, Artificial Sequence
  Description of Artificial Sequence: Synthetic oligonucleotide
cuguucuagaauguccugcc

SEQ ID NO: 407 - RNA, 20 nt, Artificial Sequence
  Description of Artificial Sequence: Synthetic oligonucleotide
cccucugggccucccagucc

SEQ ID NO: 408 - RNA, 20 nt, Artificial Sequence
  Description of Artificial Sequence: Synthetic oligonucleotide
ccuggagagguaccucuugg

SEQ ID NO: 409 - RNA, 20 nt, Artificial Sequence
  Description of Artificial Sequence: Synthetic oligonucleotide
uuacagcuccaguccccaaa

SEQ ID NO: 410 - RNA, 20 nt, Artificial Sequence
  Description of Artificial Sequence: Synthetic oligonucleotide
uguaggcauaggugucagau

SEQ ID NO: 411 - RNA, 20 nt, Artificial Sequence
  Description of Artificial Sequence: Synthetic oligonucleotide
guuauccucaaagcagauuu

SEQ ID NO: 412 - RNA, 20 nt, Artificial Sequence
  Description of Artificial Sequence: Synthetic oligonucleotide
cugauagugcauuuuacuuu

SEQ ID NO: 413 - RNA, 20 nt, Artificial Sequence
  Description of Artificial Sequence: Synthetic oligonucleotide
auuguucuuaccauuugcca

SEQ ID NO: 414 - RNA, 20 nt, Artificial Sequence
  Description of Artificial Sequence: Synthetic oligonucleotide
ucccccuucaguuuaaugag

SEQ ID NO: 415 - RNA, 20 nt, Artificial Sequence
  Description of Artificial Sequence: Synthetic oligonucleotide
gugucuuagguacuuacaug

SEQ ID NO: 416 - RNA, 20 nt, Artificial Sequence
  Description of Artificial Sequence: Synthetic oligonucleotide
uuugcguuuaaaaucugcag

SEQ ID NO: 417 - RNA, 20 nt, Artificial Sequence
  Description of Artificial Sequence: Synthetic oligonucleotide
gagguuaaaaaguacaagug

SEQ ID NO: 418 - RNA, 20 nt, Artificial Sequence
  Description of Artificial Sequence: Synthetic oligonucleotide
cacuugggcauuaacacuuu

SEQ ID NO: 419 - RNA, 20 nt, Artificial Sequence
  Description of Artificial Sequence: Synthetic oligonucleotide
uacaguugagacucagaacu

SEQ ID NO: 420 - RNA, 20 nt, Artificial Sequence
  Description of Artificial Sequence: Synthetic oligonucleotide
guguaacauaccuggaggac

SEQ ID NO: 421 - RNA, 20 nt, Artificial Sequence
  Description of Artificial Sequence: Synthetic oligonucleotide
uggggauauggguaauugaa

SEQ ID NO: 422 - RNA, 20 nt, Artificial Sequence
  Description of Artificial Sequence: Synthetic oligonucleotide
aacugugccuggaggggccc

SEQ ID NO: 423 - RNA, 20 nt, Artificial Sequence
  Description of Artificial Sequence: Synthetic oligonucleotide
ggugguggccuccuuugacc

SEQ ID NO: 424 - RNA, 20 nt, Artificial Sequence
  Description of Artificial Sequence: Synthetic oligonucleotide
ccgcagggaccauggcagcc

SEQ ID NO: 425 - RNA, 20 nt, Artificial Sequence
  Description of Artificial Sequence: Synthetic oligonucleotide
ggguccuugaaguggccggg

SEQ ID NO: 426 - RNA, 20 nt, Artificial Sequence
  Description of Artificial Sequence: Synthetic oligonucleotide
acggccgaguugacgggguc

SEQ ID NO: 427 - RNA, 20 nt, Artificial Sequence
  Description of Artificial Sequence: Synthetic oligonucleotide
cucuaggaggagcucugcgg

SEQ ID NO: 428 - RNA, 20 nt, Artificial Sequence
  Description of Artificial Sequence: Synthetic oligonucleotide
gagcggcucaagacugucgc

SEQ ID NO: 429 - RNA, 20 nt, Artificial Sequence
  Description of Artificial Sequence: Synthetic oligonucleotide
gcugaccugaaaggcacauu

SEQ ID NO: 430 - RNA, 20 nt, Artificial Sequence
  Description of Artificial Sequence: Synthetic oligonucleotide
aggacccgaugcccaacccc

SEQ ID NO: 431 - RNA, 20 nt, Artificial Sequence
  Description of Artificial Sequence: Synthetic oligonucleotide
ccgagggcuugccaggccug

SEQ ID NO: 432 - RNA, 20 nt, Artificial Sequence
  Description of Artificial Sequence: Synthetic oligonucleotide
ccgaugcccaaccccaggcc

SEQ ID NO: 433 - RNA, 20 nt, Artificial Sequence
  Description of Artificial Sequence: Synthetic oligonucleotide
ccccaggccuggcaagcccu

SEQ ID NO: 434 - RNA, 20 nt, Artificial Sequence
  Description of Artificial Sequence: Synthetic oligonucleotide
ucguccccgaagccccgcgc

SEQ ID NO: 435 - RNA, 20 nt, Artificial Sequence
  Description of Artificial Sequence: Synthetic oligonucleotide
cagacugagaccgacgcccc

SEQ ID NO: 436 - RNA, 20 nt, Artificial Sequence
  Description of Artificial Sequence: Synthetic oligonucleotide
cgaugcuggccauggccugg

SEQ ID NO: 437 - RNA, 20 nt, Artificial Sequence
  Description of Artificial Sequence: Synthetic oligonucleotide
gagcacagccgaggccaugg

SEQ ID NO: 438 - RNA, 20 nt, Artificial Sequence
  Description of Artificial Sequence: Synthetic oligonucleotide
cugguccgccgucaccucca

SEQ ID NO: 439 - RNA, 20 nt, Artificial Sequence
  Description of Artificial Sequence: Synthetic oligonucleotide
agccgaggccauggagguga

SEQ ID NO: 440 - RNA, 20 nt, Artificial Sequence
  Description of Artificial Sequence: Synthetic oligonucleotide
cgaggccauggaggugacgg

SEQ ID NO: 441 - RNA, 20 nt, Artificial Sequence
  Description of Artificial Sequence: Synthetic oligonucleotide
uccucacaucuucauaaugg

SEQ ID NO: 442 - RNA, 20 nt, Artificial Sequence
  Description of Artificial Sequence: Synthetic oligonucleotide
caagcuggcuggaaagaaaa

SEQ ID NO: 443 - RNA, 20 nt, Artificial Sequence
  Description of Artificial Sequence: Synthetic oligonucleotide
uucugccauuacacagccua

SEQ ID NO: 444 - RNA, 20 nt, Artificial Sequence
  Description of Artificial Sequence: Synthetic oligonucleotide
cguccgccgcgagccagacc

SEQ ID NO: 445 - RNA, 20 nt, Artificial Sequence
  Description of Artificial Sequence: Synthetic oligonucleotide
ggccgguucccccggucaug

SEQ ID NO: 446 - RNA, 20 nt, Artificial Sequence
  Description of Artificial Sequence: Synthetic oligonucleotide
ggggcacgggggcgcggguc

SEQ ID NO: 447 - RNA, 20 nt, Artificial Sequence
  Description of Artificial Sequence: Synthetic oligonucleotide
ccauggcucauguccccgcu

SEQ ID NO: 448 - RNA, 20 nt, Artificial Sequence
  Description of Artificial Sequence: Synthetic oligonucleotide
cguuguuucugcuguugcuc

SEQ ID NO: 449 - RNA, 20 nt, Artificial Sequence
  Description of Artificial Sequence: Synthetic oligonucleotide
cgcgggcagugcggaccagg

SEQ ID NO: 450 - RNA, 20 nt, Artificial Sequence
  Description of Artificial Sequence: Synthetic oligonucleotide
acggggcagccguccggcuc

SEQ ID NO: 451 - RNA, 20 nt, Artificial Sequence
  Description of Artificial Sequence: Synthetic oligonucleotide
ucugcgacuugaugcucucu

SEQ ID NO: 452 - RNA, 20 nt, Artificial Sequence
  Description of Artificial Sequence: Synthetic oligonucleotide
caccaccucgcggcugaugu

SEQ ID NO: 453 - RNA, 20 nt, Artificial Sequence
  Description of Artificial Sequence: Synthetic oligonucleotide
caccguccugaguucuugcc

SEQ ID NO: 454 - RNA, 20 nt, Artificial Sequence
  Description of Artificial Sequence: Synthetic oligonucleotide
gcucgccucggccagagaca

SEQ ID NO: 455 - RNA, 20 nt, Artificial Sequence
  Description of Artificial Sequence: Synthetic oligonucleotide
cucucggaaucuggagucuu

SEQ ID NO: 456 - RNA, 20 nt, Artificial Sequence
  Description of Artificial Sequence: Synthetic oligonucleotide
gcgggccuaagauguguccu

SEQ ID NO: 457 - RNA, 20 nt, Artificial Sequence
  Description of Artificial Sequence: Synthetic oligonucleotide
cugcaguggcuuccccugua

SEQ ID NO: 458 - RNA, 20 nt, Artificial Sequence
  Description of Artificial Sequence: Synthetic oligonucleotide
aggcacccccagugggcugu

SEQ ID NO: 459 - RNA, 20 nt, Artificial Sequence
  Description of Artificial Sequence: Synthetic oligonucleotide
aaaauuuucuucaagauaua

SEQ ID NO: 460 - RNA, 20 nt, Artificial Sequence
  Description of Artificial Sequence: Synthetic oligonucleotide
ccuuaucuaagcccagaaau

SEQ ID NO: 461 - RNA, 20 nt, Artificial Sequence
  Description of Artificial Sequence: Synthetic oligonucleotide
guuaauucuggcuuugggcc

SEQ ID NO: 462 - RNA, 20 nt, Artificial Sequence
  Description of Artificial Sequence: Synthetic oligonucleotide
cccuggccugaagacguucc

SEQ ID NO: 463 - RNA, 20 nt, Artificial Sequence
  Description of Artificial Sequence: Synthetic oligonucleotide
ugacuugggccagagacccc

SEQ ID NO: 464 - RNA, 20 nt, Artificial Sequence
  Description of Artificial Sequence: Synthetic oligonucleotide
gguaccaaagcaagaaagug

SEQ ID NO: 465 - RNA, 20 nt, Artificial Sequence
  Description of Artificial Sequence: Synthetic oligonucleotide
gcggcuucgcaugcccuugg

SEQ ID NO: 466 - RNA, 20 nt, Artificial Sequence
  Description of Artificial Sequence: Synthetic oligonucleotide
ggauuugcccgguuuccagc

SEQ ID NO: 467 - RNA, 20 nt, Artificial Sequence
  Description of Artificial Sequence: Synthetic oligonucleotide
gcccgccauggauacuccca

SEQ ID NO: 468 - RNA, 20 nt, Artificial Sequence
  Description of Artificial Sequence: Synthetic oligonucleotide
agcgccugccgcccccgcga

SEQ ID NO: 469 - RNA, 20 nt, Artificial Sequence
  Description of Artificial Sequence: Synthetic oligonucleotide
gcugggccgguccggagccc

SEQ ID NO: 470 - RNA, 20 nt, Artificial Sequence
  Description of Artificial Sequence: Synthetic oligonucleotide
ugcgggcgccgcggcugucc

SEQ ID NO: 471 - RNA, 20 nt, Artificial Sequence
  Description of Artificial Sequence: Synthetic oligonucleotide
auaccuguuaccuggucucc

SEQ ID NO: 472 - RNA, 20 nt, Artificial Sequence
  Description of Artificial Sequence: Synthetic oligonucleotide
agagccgaacaguguuguag

SEQ ID NO: 473 - RNA, 20 nt, Artificial Sequence
  Description of Artificial Sequence: Synthetic oligonucleotide
cuauaagacauaugcuacca

SEQ ID NO: 474 - RNA, 20 nt, Artificial Sequence
  Description of Artificial Sequence: Synthetic oligonucleotide
gucccgggugagagcggcca

SEQ ID NO: 475 - RNA, 20 nt, Artificial Sequence
  Description of Artificial Sequence: Synthetic oligonucleotide
ucagcucggagcggugcucg

SEQ ID NO: 476 - RNA, 20 nt, Artificial Sequence
  Description of Artificial Sequence: Synthetic oligonucleotide
cggcccgcccgcaccugaag

SEQ ID NO: 477 - RNA, 20 nt, Artificial Sequence
  Description of Artificial Sequence: Synthetic oligonucleotide
uaugagccgcacagccuaca

SEQ ID NO: 478 - RNA, 20 nt, Artificial Sequence
  Description of Artificial Sequence: Synthetic oligonucleotide
cccuucagcagccggcagca

SEQ ID NO: 479 - RNA, 20 nt, Artificial Sequence
  Description of Artificial Sequence: Synthetic oligonucleotide
uugugcugggccuugucugg

SEQ ID NO: 480 - RNA, 20 nt, Artificial Sequence
  Description of Artificial Sequence: Synthetic oligonucleotide
cggugaccaccagggccucc

SEQ ID NO: 481 - RNA, 20 nt, Artificial Sequence
  Description of Artificial Sequence: Synthetic oligonucleotide
gcagcaacaacucggagaga

SEQ ID NO: 482 - RNA, 20 nt, Artificial Sequence
  Description of Artificial Sequence: Synthetic oligonucleotide
gcuuucccuguccuuguucc

SEQ ID NO: 483 - RNA, 20 nt, Artificial Sequence
  Description of Artificial Sequence: Synthetic oligonucleotide
caggcagaccauguggaccc

SEQ ID NO: 484 - RNA, 20 nt, Artificial Sequence
  Description of Artificial Sequence: Synthetic oligonucleotide
gcuggaacgcggugcccaga

SEQ ID NO: 485 - RNA, 20 nt, Artificial Sequence
  Description of Artificial Sequence: Synthetic oligonucleotide
agcuggcuccuccggggucc

SEQ ID NO: 486 - RNA, 20 nt, Artificial Sequence
  Description of Artificial Sequence: Synthetic oligonucleotide
caccuuucugcagaacuucc

SEQ ID NO: 487 - RNA, 20 nt, Artificial Sequence
  Description of Artificial Sequence: Synthetic oligonucleotide
uacgggagggacagacacuu

SEQ ID NO: 488 - RNA, 20 nt, Artificial Sequence
  Description of Artificial Sequence: Synthetic oligonucleotide
ccagucuggugcugguuggg

SEQ ID NO: 489 - RNA, 20 nt, Artificial Sequence
  Description of Artificial Sequence: Synthetic oligonucleotide
aggagcggagggcucgacag

SEQ ID NO: 490 - RNA, 20 nt, Artificial Sequence
  Description of Artificial Sequence: Synthetic oligonucleotide
ucaucaggagcacuucgagg

SEQ ID NO: 491 - RNA, 20 nt, Artificial Sequence
  Description of Artificial Sequence: Synthetic oligonucleotide
cguacucagcauugcagcgg

SEQ ID NO: 492 - RNA, 20 nt, Artificial Sequence
  Description of Artificial Sequence: Synthetic oligonucleotide
gauacucacggaggccucuu

SEQ ID NO: 493 - RNA, 20 nt, Artificial Sequence
  Description of Artificial Sequence: Synthetic oligonucleotide
gauacucacggaggccucuu

SEQ ID NO: 494 - RNA, 20 nt, Artificial Sequence
  Description of Artificial Sequence: Synthetic oligonucleotide
gauacucacggaggccucuu

SEQ ID NO: 495 - RNA, 20 nt, Artificial Sequence
  Description of Artificial Sequence: Synthetic oligonucleotide
gcgugggccacaguccugug

SEQ ID NO: 496 - RNA, 20 nt, Artificial Sequence
  Description of Artificial Sequence: Synthetic oligonucleotide
ugcugugggcuugagcucca

SEQ ID NO: 497 - RNA, 20 nt, Artificial Sequence
  Description of Artificial Sequence: Synthetic oligonucleotide
gcagcccccagcaugcgggc

SEQ ID NO: 498 - RNA, 20 nt, Artificial Sequence
  Description of Artificial Sequence: Synthetic oligonucleotide
ucauguuccugaaggugucc

SEQ ID NO: 499 - RNA, 20 nt, Artificial Sequence
  Description of Artificial Sequence: Synthetic oligonucleotide
cauguuccugaaggugucca

SEQ ID NO: 500 - RNA, 20 nt, Artificial Sequence
  Description of Artificial Sequence: Synthetic oligonucleotide
auguuccugaagguguccag

SEQ ID NO: 501 - RNA, 20 nt, Artificial Sequence
  Description of Artificial Sequence: Synthetic oligonucleotide
uccugaagguguccaggggc

SEQ ID NO: 502 - RNA, 20 nt, Artificial Sequence
  Description of Artificial Sequence: Synthetic oligonucleotide
uuuuaugcaggagaaaucaa

SEQ ID NO: 503 - RNA, 20 nt, Artificial Sequence
  Description of Artificial Sequence: Synthetic oligonucleotide
gagauguuuauauuucacaa

SEQ ID NO: 504 - RNA, 20 nt, Artificial Sequence
  Description of Artificial Sequence: Synthetic oligonucleotide
auguuuauauuucacaacgg

SEQ ID NO: 505 - RNA, 20 nt, Artificial Sequence
  Description of Artificial Sequence: Synthetic oligonucleotide
uuuaaaaugcaguugcugaa

SEQ ID NO: 506 - RNA, 20 nt, Artificial Sequence
  Description of Artificial Sequence: Synthetic oligonucleotide
caaacuccuccugggggauu

SEQ ID NO: 507 - RNA, 20 nt, Artificial Sequence
  Description of Artificial Sequence: Synthetic oligonucleotide
caaacuccuccugggggauu

SEQ ID NO: 508 - RNA, 20 nt, Artificial Sequence
  Description of Artificial Sequence: Synthetic oligonucleotide
caaacuccuccugggggauu

SEQ ID NO: 509 - RNA, 20 nt, Artificial Sequence
  Description of Artificial Sequence: Synthetic oligonucleotide
caggaggacuuugaugcuca

SEQ ID NO: 510 - RNA, 20 nt, Artificial Sequence
  Description of Artificial Sequence: Synthetic oligonucleotide
aagcaaagggcaaugccauu

SEQ ID NO: 511 - RNA, 20 nt, Artificial Sequence
  Description of Artificial Sequence: Synthetic oligonucleotide
aagcaaagggcaaugccauu

SEQ ID NO: 512 - RNA, 20 nt, Artificial Sequence
  Description of Artificial Sequence: Synthetic oligonucleotide
caucucauggaaggcagaga

SEQ ID NO: 513 - RNA, 20 nt, Artificial Sequence
  Description of Artificial Sequence: Synthetic oligonucleotide
auaugauuucggauuccccc

SEQ ID NO: 514 - RNA, 20 nt, Artificial Sequence
  Description of Artificial Sequence: Synthetic oligonucleotide
auaugauuucggauuccccc

SEQ ID NO: 515 - RNA, 20 nt, Artificial Sequence
  Description of Artificial Sequence: Synthetic oligonucleotide
ucaagguccuccugcuaccc

SEQ ID NO: 516 - RNA, 20 nt, Artificial Sequence
  Description of Artificial Sequence: Synthetic oligonucleotide
caccaguaaagcaaagguca

SEQ ID NO: 517 - RNA, 20 nt, Artificial Sequence
  Description of Artificial Sequence: Synthetic oligonucleotide
caccaguaaagcaaagguca

SEQ ID NO: 518 - RNA, 20 nt, Artificial Sequence
  Description of Artificial Sequence: Synthetic oligonucleotide
uugaugauaauggcacaaau

SEQ ID NO: 519 - RNA, 20 nt, Artificial Sequence
  Description of Artificial Sequence: Synthetic oligonucleotide
cuugcccuuuguuuuacuga

SEQ ID NO: 520 - RNA, 20 nt, Artificial Sequence
  Description of Artificial Sequence: Synthetic oligonucleotide
cuugcccuuuguuuuacuga

SEQ ID NO: 521 - RNA, 20 nt, Artificial Sequence
  Description of Artificial Sequence: Synthetic oligonucleotide
aggucugcugaaucaccuca

SEQ ID NO: 522 - RNA, 20 nt, Artificial Sequence
  Description of Artificial Sequence: Synthetic oligonucleotide
acaugacuucagauuucccc

SEQ ID NO: 523 - RNA, 20 nt, Artificial Sequence
  Description of Artificial Sequence: Synthetic oligonucleotide
ucaugguccuccugugaccc

SEQ ID NO: 524 - RNA, 20 nt, Artificial Sequence
  Description of Artificial Sequence: Synthetic oligonucleotide
uacaagucauucagcucucu

SEQ ID NO: 525 - RNA, 20 nt, Artificial Sequence
  Description of Artificial Sequence: Synthetic oligonucleotide
guuuaucaucaaacuccucc

SEQ ID NO: 526 - RNA, 20 nt, Artificial Sequence
  Description of Artificial Sequence: Synthetic oligonucleotide
guuuaucaucaaacuccucc

SEQ ID NO: 527 - RNA, 20 nt, Artificial Sequence
  Description of Artificial Sequence: Synthetic oligonucleotide
uuuacuuuaaagaacuggga

SEQ ID NO: 528 - RNA, 20 nt, Artificial Sequence
  Description of Artificial Sequence: Synthetic oligonucleotide
gagugaagaaaaguugcauu

SEQ ID NO: 529 - RNA, 20 nt, Artificial Sequence
  Description of Artificial Sequence: Synthetic oligonucleotide
aaacacuucuucaugguaug

SEQ ID NO: 530 - RNA, 20 nt, Artificial Sequence
  Description of Artificial Sequence: Synthetic oligonucleotide
uaaaccagaagauuugaagg

SEQ ID NO: 531 - RNA, 20 nt, Artificial Sequence
  Description of Artificial Sequence: Synthetic oligonucleotide
ugaguggagaagcacacacg

SEQ ID NO: 532 - RNA, 20 nt, Artificial Sequence
  Description of Artificial Sequence: Synthetic oligonucleotide
ucaguugcucacacaauuuc

SEQ ID NO: 533 - RNA, 20 nt, Artificial Sequence
  Description of Artificial Sequence: Synthetic oligonucleotide
uugaauacugccucaaggac

SEQ ID NO: 534 - RNA, 20 nt, Artificial Sequence
  Description of Artificial Sequence: Synthetic oligonucleotide
gaaaauugcugcuucuuugu

SEQ ID NO: 535 - RNA, 20 nt, Artificial Sequence
  Description of Artificial Sequence: Synthetic oligonucleotide
agcacaacaggagagcaauu

SEQ ID NO: 536 - RNA, 20 nt, Artificial Sequence
  Description of Artificial Sequence: Synthetic oligonucleotide
uggccagaguguguccuuuu

SEQ ID NO: 537 - RNA, 20 nt, Artificial Sequence
  Description of Artificial Sequence: Synthetic oligonucleotide
uagacacugcugaauugaca

SEQ ID NO: 538 - RNA, 20 nt, Artificial Sequence
  Description of Artificial Sequence: Synthetic oligonucleotide
cuugauucacuugucuuugc

SEQ ID NO: 539 - RNA, 20 nt, Artificial Sequence
  Description of Artificial Sequence: Synthetic oligonucleotide
uuuuuaauaguacuuguuug

SEQ ID NO: 540 - RNA, 20 nt, Artificial Sequence
  Description of Artificial Sequence: Synthetic oligonucleotide
cuucuuuuacauaugggucc

SEQ ID NO: 541 - RNA, 20 nt, Artificial Sequence
  Description of Artificial Sequence: Synthetic oligonucleotide
gaaauauacaaguuauaucu

SEQ ID NO: 542 - RNA, 20 nt, Artificial Sequence
  Description of Artificial Sequence: Synthetic oligonucleotide
auuguacacccuaauguaac

SEQ ID NO: 543 - RNA, 20 nt, Artificial Sequence
  Description of Artificial Sequence: Synthetic oligonucleotide
cuccauuuacaaaaacugaa

SEQ ID NO: 544 - RNA, 20 nt, Artificial Sequence
  Description of Artificial Sequence: Synthetic oligonucleotide
uuucugauauccaguuuagg

SEQ ID NO: 545 - RNA, 20 nt, Artificial Sequence
  Description of Artificial Sequence: Synthetic oligonucleotide
uuguggcuugagauccuuau

SEQ ID NO: 546 - RNA, 20 nt, Artificial Sequence
  Description of Artificial Sequence: Synthetic oligonucleotide
cguucaguaaguuacagucc

SEQ ID NO: 547 - RNA, 20 nt, Artificial Sequence
  Description of Artificial Sequence: Synthetic oligonucleotide
uuuucucguagacauucuac

SEQ ID NO: 548 - RNA, 20 nt, Artificial Sequence
  Description of Artificial Sequence: Synthetic oligonucleotide
auuuagccauggcugcagcu

SEQ ID NO: 549 - RNA, 20 nt, Artificial Sequence
  Description of Artificial Sequence: Synthetic oligonucleotide
guggcagcccuucccaguug

SEQ ID NO: 550 - RNA, 20 nt, Artificial Sequence
  Description of Artificial Sequence: Synthetic oligonucleotide
uagcgagcuucaagaaggcc

SEQ ID NO: 551 - RNA, 20 nt, Artificial Sequence
  Description of Artificial Sequence: Synthetic oligonucleotide
cgggccugugugagucguca

SEQ ID NO: 552 - RNA, 20 nt, Artificial Sequence
  Description of Artificial Sequence: Synthetic oligonucleotide
ccaagacaucccccagggcu

SEQ ID NO: 553 - RNA, 20 nt, Artificial Sequence
  Description of Artificial Sequence: Synthetic oligonucleotide
ccaagacaucccccagggcu

SEQ ID NO: 554 - RNA, 20 nt, Artificial Sequence
  Description of Artificial Sequence: Synthetic oligonucleotide
cucccuuuuaccaucuccug

SEQ ID NO: 555 - RNA, 20 nt, Artificial Sequence
  Description of Artificial Sequence: Synthetic oligonucleotide
cauuuggugcagaagcacca

SEQ ID NO: 556 - RNA, 20 nt, Artificial Sequence
  Description of Artificial Sequence: Synthetic oligonucleotide
agauccaacagggcuauagc

SEQ ID NO: 557 - RNA, 20 nt, Artificial Sequence
  Description of Artificial Sequence: Synthetic oligonucleotide
cggagaucucgaagcauguu

SEQ ID NO: 558 - RNA, 20 nt, Artificial Sequence
  Description of Artificial Sequence: Synthetic oligonucleotide
ucagacugggugcccuggcc

SEQ ID NO: 559 - RNA, 20 nt, Artificial Sequence
  Description of Artificial Sequence: Synthetic oligonucleotide
cucagcacugcucuguugcc

SEQ ID NO: 560 - RNA, 20 nt, Artificial Sequence
  Description of Artificial Sequence: Synthetic oligonucleotide
ggucuggcuacaguuggaga

SEQ ID NO: 561 - RNA, 20 nt, Artificial Sequence
  Description of Artificial Sequence: Synthetic oligonucleotide
gguagccauugcugugguac

SEQ ID NO: 562 - RNA, 20 nt, Artificial Sequence
  Description of Artificial Sequence: Synthetic oligonucleotide
gguguuggugacgguccagu

SEQ ID NO: 563 - RNA, 20 nt, Artificial Sequence
  Description of Artificial Sequence: Synthetic oligonucleotide
cgugccgcagguaggacagu

SEQ ID NO: 564 - RNA, 20 nt, Artificial Sequence
  Description of Artificial Sequence: Synthetic oligonucleotide
cggcucuauccccagcuccc

SEQ ID NO: 565 - RNA, 20 nt, Artificial Sequence
  Description of Artificial Sequence: Synthetic oligonucleotide
cacugggagcucuacaggua

SEQ ID NO: 566 - RNA, 20 nt, Artificial Sequence
  Description of Artificial Sequence: Synthetic oligonucleotide
aguguccugguuucgggaug

SEQ ID NO: 567 - RNA, 20 nt, Artificial Sequence
  Description of Artificial Sequence: Synthetic oligonucleotide
gcuagggcaugaacuggucc

SEQ ID NO: 568 - RNA, 20 nt, Artificial Sequence
  Description of Artificial Sequence: Synthetic oligonucleotide
ugcccccaagugcaccaucc

SEQ ID NO: 569 - RNA, 20 nt, Artificial Sequence
  Description of Artificial Sequence: Synthetic oligonucleotide
ccaggguagccacaaggagg

SEQ ID NO: 570 - RNA, 20 nt, Artificial Sequence
  Description of Artificial Sequence: Synthetic oligonucleotide
ggucuggaguggccacgggg

SEQ ID NO: 571 - RNA, 20 nt, Artificial Sequence
  Description of Artificial Sequence: Synthetic oligonucleotide
ugacggcccucagcagguuu

SEQ ID NO: 572 - RNA, 20 nt, Artificial Sequence
  Description of Artificial Sequence: Synthetic oligonucleotide
acucuuugacuuggaugguc

SEQ ID NO: 573 - RNA, 20 nt, Artificial Sequence
  Description of Artificial Sequence: Synthetic oligonucleotide
ggugauaccaucuucuucag

SEQ ID NO: 574 - RNA, 20 nt, Artificial Sequence
  Description of Artificial Sequence: Synthetic oligonucleotide
uuuaugucguagaauuggau

SEQ ID NO: 575 - RNA, 20 nt, Artificial Sequence
  Description of Artificial Sequence: Synthetic oligonucleotide
cacuuccugcgguguuggug

SEQ ID NO: 576 - RNA, 20 nt, Artificial Sequence
  Description of Artificial Sequence: Synthetic oligonucleotide
ggagcacucguaacgaucac

SEQ ID NO: 577 - RNA, 20 nt, Artificial Sequence
  Description of Artificial Sequence: Synthetic oligonucleotide
aucucuuccaggcucggccu

SEQ ID NO: 578 - RNA, 20 nt, Artificial Sequence
  Description of Artificial Sequence: Synthetic oligonucleotide
cauggcgcuuuuguugacca

SEQ ID NO: 579 - RNA, 20 nt, Artificial Sequence
  Description of Artificial Sequence: Synthetic oligonucleotide
gccucccucuacagcccuca

SEQ ID NO: 580 - RNA, 20 nt, Artificial Sequence
  Description of Artificial Sequence: Synthetic oligonucleotide
cgacacucaccuucugguuc

SEQ ID NO: 581 - RNA, 20 nt, Artificial Sequence
  Description of Artificial Sequence: Synthetic oligonucleotide
auggaaauacuucucaaaug

SEQ ID NO: 582 - RNA, 20 nt, Artificial Sequence
  Description of Artificial Sequence: Synthetic oligonucleotide
ggcauucaugucuucauuuu

SEQ ID NO: 583 - RNA, 20 nt, Artificial Sequence
  Description of Artificial Sequence: Synthetic oligonucleotide
auggucaugaugauuguccu

SEQ ID NO: 584 - RNA, 20 nt, Artificial Sequence
  Description of Artificial Sequence: Synthetic oligonucleotide
caaaauuucgguccaucucc

SEQ ID NO: 585 - RNA, 20 nt, Artificial Sequence
  Description of Artificial Sequence: Synthetic oligonucleotide
agggcuagagccaucaucac

SEQ ID NO: 586 - RNA, 20 nt, Artificial Sequence
  Description of Artificial Sequence: Synthetic oligonucleotide
ggaaaauucccuccuugccc

SEQ ID NO: 587 - RNA, 20 nt, Artificial Sequence
  Description of Artificial Sequence: Synthetic oligonucleotide
gcuacugcugcugagccugg

SEQ ID NO: 588 - RNA, 20 nt, Artificial Sequence
  Description of Artificial Sequence: Synthetic oligonucleotide
ucaaccugaacauccauaac

SEQ ID NO: 589 - RNA, 20 nt, Artificial Sequence
  Description of Artificial Sequence: Synthetic oligonucleotide
ggaucgguuguaguaaucug

SEQ ID NO: 590 - RNA, 20 nt, Artificial Sequence
  Description of Artificial Sequence: Synthetic oligonucleotide
gcucugagcuguuccucagc

SEQ ID NO: 591 - RNA, 20 nt, Artificial Sequence
  Description of Artificial Sequence: Synthetic oligonucleotide
gaaaccguaugcccgcaugg

SEQ ID NO: 592 - RNA, 20 nt, Artificial Sequence
  Description of Artificial Sequence: Synthetic oligonucleotide
cucuugcuuuuggggcuccu

SEQ ID NO: 593 - RNA, 20 nt, Artificial Sequence
  Description of Artificial Sequence: Synthetic oligonucleotide
ucagaaacaggaggccgggg

SEQ ID NO: 594 - RNA, 20 nt, Artificial Sequence
  Description of Artificial Sequence: Synthetic oligonucleotide
cgguaccccacacugcuacu

SEQ ID NO: 595 - RNA, 20 nt, Artificial Sequence
  Description of Artificial Sequence: Synthetic oligonucleotide
gcaccucgagccagcaggug

SEQ ID NO: 596 - RNA, 20 nt, Artificial Sequence
  Description of Artificial Sequence: Synthetic oligonucleotide
cggcagcgccagcaggaagc

SEQ ID NO: 597 - RNA, 20 nt, Artificial Sequence
  Description of Artificial Sequence: Synthetic oligonucleotide
ggaccggccggaggagcuac

SEQ ID NO: 598 - RNA, 20 nt, Artificial Sequence
  Description of Artificial Sequence: Synthetic oligonucleotide
guggaaggcacugagcacgc

SEQ ID NO: 599 - RNA, 20 nt, Artificial Sequence
  Description of Artificial Sequence: Synthetic oligonucleotide
gguaguaugaagcuugacau

SEQ ID NO: 600 - RNA, 20 nt, Artificial Sequence
  Description of Artificial Sequence: Synthetic oligonucleotide
gaaaaaaguauguccuacuu

SEQ ID NO: 601 - RNA, 20 nt, Artificial Sequence
  Description of Artificial Sequence: Synthetic oligonucleotide
uacuugcugcugucgauauu

SEQ ID NO: 602 - RNA, 20 nt, Artificial Sequence
  Description of Artificial Sequence: Synthetic oligonucleotide
ggaaauaauuuuguucucac

SEQ ID NO: 603 - RNA, 20 nt, Artificial Sequence
  Description of Artificial Sequence: Synthetic oligonucleotide
uuacagccauaccucuaggc

SEQ ID NO: 604 - RNA, 20 nt, Artificial Sequence
  Description of Artificial Sequence: Synthetic oligonucleotide
uuauuucagauaaugcaccc

SEQ ID NO: 605 - RNA, 20 nt, Artificial Sequence
  Description of Artificial Sequence: Synthetic oligonucleotide
gcaggacccacaaagggcug

SEQ ID NO: 606 - RNA, 20 nt, Artificial Sequence
  Description of Artificial Sequence: Synthetic oligonucleotide
ugugcuucuaacugaggcag

SEQ ID NO: 607 - RNA, 20 nt, Artificial Sequence
  Description of Artificial Sequence: Synthetic oligonucleotide
gcuggacacugcuuagcugc

SEQ ID NO: 608 - RNA, 20 nt, Artificial Sequence
  Description of Artificial Sequence: Synthetic oligonucleotide
aguuacaguguguuucccuu

SEQ ID NO: 609 - RNA, 20 nt, Artificial Sequence
  Description of Artificial Sequence: Synthetic oligonucleotide
caguagacaaccacggucuc

SEQ ID NO: 610 - RNA, 20 nt, Artificial Sequence
  Description of Artificial Sequence: Synthetic oligonucleotide
cuuggaaacucucuucuaua

SEQ ID NO: 611 - RNA, 20 nt, Artificial Sequence
  Description of Artificial Sequence: Synthetic oligonucleotide
ggaagguucugaagaagaga

SEQ ID NO: 612 - RNA, 20 nt, Artificial Sequence
  Description of Artificial Sequence: Synthetic oligonucleotide
gguaagcuuggauguuuuag

SEQ ID NO: 613 - RNA, 20 nt, Artificial Sequence
  Description of Artificial Sequence: Synthetic oligonucleotide
gccauagcuuacaugauaga

SEQ ID NO: 614 - RNA, 20 nt, Artificial Sequence
  Description of Artificial Sequence: Synthetic oligonucleotide
cauucuccuggaaggucugu

SEQ ID NO: 615 - RNA, 20 nt, Artificial Sequence
  Description of Artificial Sequence: Synthetic oligonucleotide
cauggccacaacaacugacg

SEQ ID NO: 616 - RNA, 20 nt, Artificial Sequence
  Description of Artificial Sequence: Synthetic oligonucleotide
cucuccgcagugcuccuucc

SEQ ID NO: 617 - RNA, 20 nt, Artificial Sequence
  Description of Artificial Sequence: Synthetic oligonucleotide
aucugcauacuuccuaacag

SEQ ID NO: 618 - RNA, 20 nt, Artificial Sequence
  Description of Artificial Sequence: Synthetic oligonucleotide
ccaggcagcggcucccuccc

SEQ ID NO: 619 - RNA, 20 nt, Artificial Sequence
  Description of Artificial Sequence: Synthetic oligonucleotide
ggccucucaccuccagcugu

SEQ ID NO: 620 - RNA, 20 nt, Artificial Sequence
  Description of Artificial Sequence: Synthetic oligonucleotide
uccuuuuaaagauaaaugca

SEQ ID NO: 621 - RNA, 20 nt, Artificial Sequence
  Description of Artificial Sequence: Synthetic oligonucleotide
cuuaacccaaaugaacacaa

SEQ ID NO: 622 - RNA, 20 nt, Artificial Sequence
  Description of Artificial Sequence: Synthetic oligonucleotide
uaucuacagaacaagccucc

SEQ ID NO: 623 - RNA, 20 nt, Artificial Sequence
  Description of Artificial Sequence: Synthetic oligonucleotide
ccagaagcugccgguuucgu

SEQ ID NO: 624 - RNA, 20 nt, Artificial Sequence
  Description of Artificial Sequence: Synthetic oligonucleotide
uguagcccugaggugccccc

SEQ ID NO: 625 - RNA, 20 nt, Artificial Sequence
  Description of Artificial Sequence: Synthetic oligonucleotide
uaaaaaugacucugcuagga

SEQ ID NO: 626 - RNA, 20 nt, Artificial Sequence
  Description of Artificial Sequence: Synthetic oligonucleotide
aauucuuaaggagcaucuug

SEQ ID NO: 627 - RNA, 20 nt, Artificial Sequence
  Description of Artificial Sequence: Synthetic oligonucleotide
cucuguggaagaaggugacu

SEQ ID NO: 628 - RNA, 20 nt, Artificial Sequence
  Description of Artificial Sequence: Synthetic oligonucleotide
uacacucaccucguuuauga

SEQ ID NO: 629 - RNA, 20 nt, Artificial Sequence
  Description of Artificial Sequence: Synthetic oligonucleotide
uuucuuauuucagaauuguc

SEQ ID NO: 630 - RNA, 20 nt, Artificial Sequence
  Description of Artificial Sequence: Synthetic oligonucleotide
aaugugaugacugaggacgc

SEQ ID NO: 631 - RNA, 20 nt, Artificial Sequence
  Description of Artificial Sequence: Synthetic oligonucleotide
acccuugaccgugaaggacc

SEQ ID NO: 632 - RNA, 20 nt, Artificial Sequence
  Description of Artificial Sequence: Synthetic oligonucleotide
uuccccagaaaagauagaug

SEQ ID NO: 633 - RNA, 20 nt, Artificial Sequence
  Description of Artificial Sequence: Synthetic oligonucleotide
acaggcacaucuucccucca

SEQ ID NO: 634 - RNA, 20 nt, Artificial Sequence
  Description of Artificial Sequence: Synthetic oligonucleotide
agcauguuuuuaccuccagc

SEQ ID NO: 635 - RNA, 20 nt, Artificial Sequence
  Description of Artificial Sequence: Synthetic oligonucleotide
uguaauaauuuuaguaagaa

SEQ ID NO: 636 - RNA, 20 nt, Artificial Sequence
  Description of Artificial Sequence: Synthetic oligonucleotide
acaacuggagcauuuacugc

SEQ ID NO: 637 - RNA, 20 nt, Artificial Sequence
  Description of Artificial Sequence: Synthetic oligonucleotide
gacuuagugcaaugcaagac

SEQ ID NO: 638 - RNA, 20 nt, Artificial Sequence
  Description of Artificial Sequence: Synthetic oligonucleotide
aaggcugaaggcaagacuag

SEQ ID NO: 639 - RNA, 20 nt, Artificial Sequence
  Description of Artificial Sequence: Synthetic oligonucleotide
uggacugaagacacucaauu

SEQ ID NO: 640 - RNA, 20 nt, Artificial Sequence
  Description of Artificial Sequence: Synthetic oligonucleotide
uucugagauacggggcagug

SEQ ID NO: 641 - RNA, 20 nt, Artificial Sequence
  Description of Artificial Sequence: Synthetic oligonucleotide
cauccccgacccgcaccugg

SEQ ID NO: 642 - RNA, 20 nt, Artificial Sequence
  Description of Artificial Sequence: Synthetic oligonucleotide
uguugcuccuggcggcgccu

SEQ ID NO: 643 - RNA, 20 nt, Artificial Sequence
  Description of Artificial Sequence: Synthetic oligonucleotide
ccgccgcccaugcgggcucc

SEQ ID NO: 644 - RNA, 20 nt, Artificial Sequence
  Description of Artificial Sequence: Synthetic oligonucleotide
agugagugagcaccagcugc

SEQ ID NO: 645 - RNA, 20 nt, Artificial Sequence
  Description of Artificial Sequence: Synthetic oligonucleotide
ugccauacaaccuucguguc

SEQ ID NO: 646 - RNA, 20 nt, Artificial Sequence
  Description of Artificial Sequence: Synthetic oligonucleotide
uucuauuaaagggaugcuuc

SEQ ID NO: 647 - RNA, 20 nt, Artificial Sequence
  Description of Artificial Sequence: Synthetic oligonucleotide
gaaaaauuaugugaaugacu

SEQ ID NO: 648 - RNA, 20 nt, Artificial Sequence
  Description of Artificial Sequence: Synthetic oligonucleotide
ucauguggcgaucuugaccu

SEQ ID NO: 649 - RNA, 20 nt, Artificial Sequence
  Description of Artificial Sequence: Synthetic oligonucleotide
acaauccucuccauguugcc

SEQ ID NO: 650 - RNA, 20 nt, Artificial Sequence
  Description of Artificial Sequence: Synthetic oligonucleotide
uggacuugucaagccugcag

SEQ ID NO: 651 - RNA, 20 nt, Artificial Sequence
  Description of Artificial Sequence: Synthetic oligonucleotide
ucucuuggcccucuugguac

SEQ ID NO: 652 - RNA, 20 nt, Artificial Sequence
  Description of Artificial Sequence: Synthetic oligonucleotide
aagagcucacagauuucugc

SEQ ID NO: 653 - RNA, 20 nt, Artificial Sequence
  Description of Artificial Sequence: Synthetic oligonucleotide
gaugucuggcugcccuaagu

SEQ ID NO: 654 - RNA, 20 nt, Artificial Sequence
  Description of Artificial Sequence: Synthetic oligonucleotide
ucuggacccagggagcccgc

SEQ ID NO: 655 - RNA, 20 nt, Artificial Sequence
  Description of Artificial Sequence: Synthetic oligonucleotide
cagggaucaggacgugcucc

SEQ ID NO: 656 - RNA, 20 nt, Artificial Sequence
  Description of Artificial Sequence: Synthetic oligonucleotide
uucugaguagcucccagccg

SEQ ID NO: 657 - RNA, 20 nt, Artificial Sequence
  Description of Artificial Sequence: Synthetic oligonucleotide
cuguaugucugagguuucac

SEQ ID NO: 658 - RNA, 20 nt, Artificial Sequence
  Description of Artificial Sequence: Synthetic oligonucleotide
acagauauggacagagacaa

SEQ ID NO: 659 - RNA, 20 nt, Artificial Sequence
  Description of Artificial Sequence: Synthetic oligonucleotide
cugcugcccuggacagcuca

SEQ ID NO: 660 - RNA, 20 nt, Artificial Sequence
  Description of Artificial Sequence: Synthetic oligonucleotide
aagcugcuggcacugagucc

SEQ ID NO: 661 - RNA, 20 nt, Artificial Sequence
  Description of Artificial Sequence: Synthetic oligonucleotide
cucaccaugugucccacuag

SEQ ID NO: 662 - RNA, 20 nt, Artificial Sequence
  Description of Artificial Sequence: Synthetic oligonucleotide
cuguugcacauauguaaaau

SEQ ID NO: 663 - RNA, 20 nt, Artificial Sequence
  Description of Artificial Sequence: Synthetic oligonucleotide
gaugucaagaaacaggcaaa

SEQ ID NO: 664 - RNA, 20 nt, Artificial Sequence
  Description of Artificial Sequence: Synthetic oligonucleotide
uaaguacacucaccuguuuc

SEQ ID NO: 665 - RNA, 20 nt, Artificial Sequence
  Description of Artificial Sequence: Synthetic oligonucleotide
ugagaggcugucgccagcaa

SEQ ID NO: 666 - RNA, 20 nt, Artificial Sequence
  Description of Artificial Sequence: Synthetic oligonucleotide
cuucucuggagccagguauc

SEQ ID NO: 667 - RNA, 20 nt, Artificial Sequence
  Description of Artificial Sequence: Synthetic oligonucleotide
acaacccccuucacuuggca

SEQ ID NO: 668 - RNA, 20 nt, Artificial Sequence
  Description of Artificial Sequence: Synthetic oligonucleotide
ccuacaggugguugcauucu

SEQ ID NO: 669 - RNA, 20 nt, Artificial Sequence
  Description of Artificial Sequence: Synthetic oligonucleotide
gagguguccugcccuuugcu

SEQ ID NO: 670 - RNA, 20 nt, Artificial Sequence
  Description of Artificial Sequence: Synthetic oligonucleotide
ugccuccccuagagccugcu

SEQ ID NO: 671 - RNA, 20 nt, Artificial Sequence
  Description of Artificial Sequence: Synthetic oligonucleotide
auagagagcgucaacagcuu

SEQ ID NO: 672 - RNA, 20 nt, Artificial Sequence
  Description of Artificial Sequence: Synthetic oligonucleotide
agauugcuugugcuuggcaa

SEQ ID NO: 673 - RNA, 20 nt, Artificial Sequence
  Description of Artificial Sequence: Synthetic oligonucleotide
ugcuggugaauuucauuuug

SEQ ID NO: 674 - RNA, 20 nt, Artificial Sequence
  Description of Artificial Sequence: Synthetic oligonucleotide
cauuagggggacuuacaaag

SEQ ID NO: 675 - RNA, 20 nt, Artificial Sequence
  Description of Artificial Sequence: Synthetic oligonucleotide
gcagcuccugcaggcucagc

SEQ ID NO: 676 - RNA, 20 nt, Artificial Sequence
  Description of Artificial Sequence: Synthetic oligonucleotide
accagcuugaaccaggagca

SEQ ID NO: 677 - RNA, 20 nt, Artificial Sequence
  Description of Artificial Sequence: Synthetic oligonucleotide
cagagcuugugcauugacau

SEQ ID NO: 678 - RNA, 20 nt, Artificial Sequence
  Description of Artificial Sequence: Synthetic oligonucleotide
gugacccgcuuuuuauucug

SEQ ID NO: 679 - RNA, 20 nt, Artificial Sequence
  Description of Artificial Sequence: Synthetic oligonucleotide
auggcuuugaauguggcgug

SEQ ID NO: 680 - RNA, 20 nt, Artificial Sequence
  Description of Artificial Sequence: Synthetic oligonucleotide
uguggccuggggacagcguc

SEQ ID NO: 681 - RNA, 20 nt, Artificial Sequence
  Description of Artificial Sequence: Synthetic oligonucleotide
cccacagaugcaacauaagc

SEQ ID NO: 682 - RNA, 20 nt, Artificial Sequence
  Description of Artificial Sequence: Synthetic oligonucleotide
guugucuccaguucgccuga

SEQ ID NO: 683 - RNA, 20 nt, Artificial Sequence
  Description of Artificial Sequence: Synthetic oligonucleotide
cauaccaauaaugcagagug

SEQ ID NO: 684 - RNA, 20 nt, Artificial Sequence
  Description of Artificial Sequence: Synthetic oligonucleotide
ucgaguacaugaauugcacu

SEQ ID NO: 685 - RNA, 20 nt, Artificial Sequence
  Description of Artificial Sequence: Synthetic oligonucleotide
gaaacacugagggagucagu

SEQ ID NO: 686 - RNA, 20 nt, Artificial Sequence
  Description of Artificial Sequence: Synthetic oligonucleotide
gcaggagcaggacgggcagg

SEQ ID NO: 687 - RNA, 20 nt, Artificial Sequence
  Description of Artificial Sequence: Synthetic oligonucleotide
caacgcccuugaagacaagc

SEQ ID NO: 688 - RNA, 20 nt, Artificial Sequence
  Description of Artificial Sequence: Synthetic oligonucleotide
cuacucaccagcaaaggcaa

SEQ ID NO: 689 - RNA, 20 nt, Artificial Sequence
  Description of Artificial Sequence: Synthetic oligonucleotide
cuuucaaaagcaucuucgag

SEQ ID NO: 690 - RNA, 20 nt, Artificial Sequence
  Description of Artificial Sequence: Synthetic oligonucleotide
guaaacggacgggcaacgug

SEQ ID NO: 691 - RNA, 20 nt, Artificial Sequence
  Description of Artificial Sequence: Synthetic oligonucleotide
agaaagagcacagacgucga

SEQ ID NO: 692 - RNA, 20 nt, Artificial Sequence
  Description of Artificial Sequence: Synthetic oligonucleotide
caacuucgcuaagaaccgua

SEQ ID NO: 693 - RNA, 20 nt, Artificial Sequence
  Description of Artificial Sequence: Synthetic oligonucleotide
agcucugcgaugugcgguca

SEQ ID NO: 694 - RNA, 20 nt, Artificial Sequence
  Description of Artificial Sequence: Synthetic oligonucleotide
cagucauucccauuuuuucu

SEQ ID NO: 695 - RNA, 20 nt, Artificial Sequence
  Description of Artificial Sequence: Synthetic oligonucleotide
cugccucucuucacagcacc

SEQ ID NO: 696 - RNA, 20 nt, Artificial Sequence
  Description of Artificial Sequence: Synthetic oligonucleotide
agaaucaggacguggacagg

SEQ ID NO: 697 - RNA, 20 nt, Artificial Sequence
  Description of Artificial Sequence: Synthetic oligonucleotide
ucagggugagaaggaugaag

SEQ ID NO: 698 - RNA, 20 nt, Artificial Sequence
  Description of Artificial Sequence: Synthetic oligonucleotide
uuguuuagaaucccaacaga

SEQ ID NO: 699 - RNA, 20 nt, Artificial Sequence
  Description of Artificial Sequence: Synthetic oligonucleotide
cucuggccuuaugauaaaaa

SEQ ID NO: 700 - RNA, 20 nt, Artificial Sequence
  Description of Artificial Sequence: Synthetic oligonucleotide
uuucagugaaggccuuuugg

SEQ ID NO: 701 - RNA, 20 nt, Artificial Sequence
  Description of Artificial Sequence: Synthetic oligonucleotide
ucuugggaucuuccuuggcg

SEQ ID NO: 702 - RNA, 20 nt, Artificial Sequence
  Description of Artificial Sequence: Synthetic oligonucleotide
gcacuccucauucugcguca

SEQ ID NO: 703 - RNA, 20 nt, Artificial Sequence
  Description of Artificial Sequence: Synthetic oligonucleotide
caggagccgacuucaguaca

SEQ ID NO: 704 - RNA, 20 nt, Artificial Sequence
  Description of Artificial Sequence: Synthetic oligonucleotide
cacaugucggcaugagauua

SEQ ID NO: 705 - RNA, 20 nt, Artificial Sequence
  Description of Artificial Sequence: Synthetic oligonucleotide
gauugaguccauucaggccc

SEQ ID NO: 706 - RNA, 20 nt, Artificial Sequence
  Description of Artificial Sequence: Synthetic oligonucleotide
acucaccuucagcugcagug

SEQ ID NO: 707 - RNA, 20 nt, Artificial Sequence
  Description of Artificial Sequence: Synthetic oligonucleotide
caagccuacuuugcagcuua

SEQ ID NO: 708 - RNA, 20 nt, Artificial Sequence
  Description of Artificial Sequence: Synthetic oligonucleotide
uaugguuuaccugggaauca

SEQ ID NO: 709 - RNA, 20 nt, Artificial Sequence
  Description of Artificial Sequence: Synthetic oligonucleotide
gcuauuaaaugaagagugac

SEQ ID NO: 710 - RNA, 20 nt, Artificial Sequence
  Description of Artificial Sequence: Synthetic oligonucleotide
ucaguguguaaaccuauuac

SEQ ID NO: 711 - RNA, 20 nt, Artificial Sequence
  Description of Artificial Sequence: Synthetic oligonucleotide
cacaagguucugacccugaa

SEQ ID NO: 712 - RNA, 20 nt, Artificial Sequence
  Description of Artificial Sequence: Synthetic oligonucleotide
cuguuugcacugcuguggcu

SEQ ID NO: 713 - RNA, 20 nt, Artificial Sequence
  Description of Artificial Sequence: Synthetic oligonucleotide
cacaggugaagagaucagcg

SEQ ID NO: 714 - RNA, 20 nt, Artificial Sequence
  Description of Artificial Sequence: Synthetic oligonucleotide
cacccaggaugacgggggac

SEQ ID NO: 715 - RNA, 20 nt, Artificial Sequence
  Description of Artificial Sequence: Synthetic oligonucleotide
ggagccgacucuaacacuag

SEQ ID NO: 716 - RNA, 20 nt, Artificial Sequence
  Description of Artificial Sequence: Synthetic oligonucleotide
gcuaaugcaaagaagaucuc

SEQ ID NO: 717 - RNA, 20 nt, Artificial Sequence
  Description of Artificial Sequence: Synthetic oligonucleotide
auucuccugggggucucuaa

SEQ ID NO: 718 - RNA, 20 nt, Artificial Sequence
  Description of Artificial Sequence: Synthetic oligonucleotide
aacucucaccuucagcugaa

SEQ ID NO: 719 - RNA, 20 nt, Artificial Sequence
  Description of Artificial Sequence: Synthetic oligonucleotide
cagagggggaagcaguuggg

SEQ ID NO: 720 - RNA, 20 nt, Artificial Sequence
  Description of Artificial Sequence: Synthetic oligonucleotide
ugauaucgcacuuguguccg

SEQ ID NO: 721 - RNA, 20 nt, Artificial Sequence
  Description of Artificial Sequence: Synthetic oligonucleotide
uacucaccuucugcucugug

SEQ ID NO: 722 - RNA, 20 nt, Artificial Sequence
  Description of Artificial Sequence: Synthetic oligonucleotide
cauaaagaaaauuaccucau

SEQ ID NO: 723 - RNA, 20 nt, Artificial Sequence
  Description of Artificial Sequence: Synthetic oligonucleotide
ugcauuggugaaagagaccu

SEQ ID NO: 724 - RNA, 20 nt, Artificial Sequence
  Description of Artificial Sequence: Synthetic oligonucleotide
cauuugaguuugcuagcucu

SEQ ID NO: 725 - RNA, 20 nt, Artificial Sequence
  Description of Artificial Sequence: Synthetic oligonucleotide
cccuccggcacaggcgccuu

SEQ ID NO: 726 - RNA, 20 nt, Artificial Sequence
  Description of Artificial Sequence: Synthetic oligonucleotide
acaucuuuggaaucuucucc

SEQ ID NO: 727 - RNA, 20 nt, Artificial Sequence
  Description of Artificial Sequence: Synthetic oligonucleotide
aacgaauugacaaacaaauu

SEQ ID NO: 728 - RNA, 20 nt, Artificial Sequence
  Description of Artificial Sequence: Synthetic oligonucleotide
caguccggccgaagacuucc

SEQ ID NO: 729 - RNA, 20 nt, Artificial Sequence
  Description of Artificial Sequence: Synthetic oligonucleotide
uaacuggcaggagaacuucu

SEQ ID NO: 730 - RNA, 20 nt, Artificial Sequence
  Description of Artificial Sequence: Synthetic oligonucleotide
cagcaaaacucaaaccuuuc

SEQ ID NO: 731 - RNA, 20 nt, Artificial Sequence
  Description of Artificial Sequence: Synthetic oligonucleotide
auuuaccuggcuccaaguug

SEQ ID NO: 732 - RNA, 20 nt, Artificial Sequence
  Description of Artificial Sequence: Synthetic oligonucleotide
uuauaacacucuuaauacuu

SEQ ID NO: 733 - RNA, 20 nt, Artificial Sequence
  Description of Artificial Sequence: Synthetic oligonucleotide
ugauaaauuauguggcggau

SEQ ID NO: 734 - RNA, 20 nt, Artificial Sequence
  Description of Artificial Sequence: Synthetic oligonucleotide
ggucagcaucgaucaauuau

SEQ ID NO: 735 - RNA, 20 nt, Artificial Sequence
  Description of Artificial Sequence: Synthetic oligonucleotide
augcuacuggcaacagaaca

SEQ ID NO: 736 - RNA, 20 nt, Artificial Sequence
  Description of Artificial Sequence: Synthetic oligonucleotide
ugucaaauuuaguuucuuuu

SEQ ID NO: 737 - RNA, 20 nt, Artificial Sequence
  Description of Artificial Sequence: Synthetic oligonucleotide
cuaccugcaucuuguugaug

SEQ ID NO: 738 - RNA, 20 nt, Artificial Sequence
  Description of Artificial Sequence: Synthetic oligonucleotide
uggacaccccuggccugcca

SEQ ID NO: 739 - RNA, 20 nt, Artificial Sequence
  Description of Artificial Sequence: Synthetic oligonucleotide
ugucaagaugcuucuggcca

SEQ ID NO: 740 - RNA, 20 nt, Artificial Sequence
  Description of Artificial Sequence: Synthetic oligonucleotide
ucagcagcaagaagagcagu

SEQ ID NO: 741 - RNA, 20 nt, Artificial Sequence
  Description of Artificial Sequence: Synthetic oligonucleotide
ccgggaacuuguucuggcca

SEQ ID NO: 742 - RNA, 20 nt, Artificial Sequence
  Description of Artificial Sequence: Synthetic oligonucleotide
ccgcggugaccagggaaggu

SEQ ID NO: 743 - RNA, 20 nt, Artificial Sequence
  Description of Artificial Sequence: Synthetic oligonucleotide
ugaacuuauggagcagaccu

SEQ ID NO: 744 - RNA, 20 nt, Artificial Sequence
  Description of Artificial Sequence: Synthetic oligonucleotide
gaacggguauguggagauag

SEQ ID NO: 745 - RNA, 20 nt, Artificial Sequence
  Description of Artificial Sequence: Synthetic oligonucleotide
ggguaccggcugggugacau

SEQ ID NO: 746 - RNA, 20 nt, Artificial Sequence
  Description of Artificial Sequence: Synthetic oligonucleotide
ggcggcggcgcggcaggcgu

SEQ ID NO: 747 - RNA, 20 nt, Artificial Sequence
  Description of Artificial Sequence: Synthetic oligonucleotide
guacgucgugcggcggcuuc

SEQ ID NO: 748 - RNA, 20 nt, Artificial Sequence
  Description of Artificial Sequence: Synthetic oligonucleotide
ugugccgcuucaccgccucc

SEQ ID NO: 749 - RNA, 20 nt, Artificial Sequence
  Description of Artificial Sequence: Synthetic oligonucleotide
aaaggccagaagcaaugagg

SEQ ID NO: 750 - RNA, 20 nt, Artificial Sequence
  Description of Artificial Sequence: Synthetic oligonucleotide
uggacacugaccgccagcuc

SEQ ID NO: 751 - RNA, 20 nt, Artificial Sequence
  Description of Artificial Sequence: Synthetic oligonucleotide
gcgggagcugcuucuugauc

SEQ ID NO: 752 - RNA, 20 nt, Artificial Sequence
  Description of Artificial Sequence: Synthetic oligonucleotide
aaaagugagcagggagcugu

SEQ ID NO: 753 - RNA, 20 nt, Artificial Sequence
  Description of Artificial Sequence: Synthetic oligonucleotide
caagcaaagagugccaggaa

SEQ ID NO: 754 - RNA, 20 nt, Artificial Sequence
  Description of Artificial Sequence: Synthetic oligonucleotide
ccaggagagugcgggacccu

SEQ ID NO: 755 - RNA, 20 nt, Artificial Sequence
  Description of Artificial Sequence: Synthetic oligonucleotide
ccaccgagagcgcauggcuu

SEQ ID NO: 756 - RNA, 20 nt, Artificial Sequence
  Description of Artificial Sequence: Synthetic oligonucleotide
gaccggccgccccuacaacg

SEQ ID NO: 757 - RNA, 20 nt, Artificial Sequence
  Description of Artificial Sequence: Synthetic oligonucleotide
agccgaacagcguguugugg

SEQ ID NO: 758 - RNA, 20 nt, Artificial Sequence
  Description of Artificial Sequence: Synthetic oligonucleotide
cggcgauggcuuuuccgccg

SEQ ID NO: 759 - RNA, 20 nt, Artificial Sequence
  Description of Artificial Sequence: Synthetic oligonucleotide
gucccgagagaagaagcggg

SEQ ID NO: 760 - RNA, 20 nt, Artificial Sequence
  Description of Artificial Sequence: Synthetic oligonucleotide
gacaguccugccgaguacuc

SEQ ID NO: 761 - RNA, 20 nt, Artificial Sequence
  Description of Artificial Sequence: Synthetic oligonucleotide
ugcuguuccuuugcuacggu

SEQ ID NO: 762 - RNA, 20 nt, Artificial Sequence
  Description of Artificial Sequence: Synthetic oligonucleotide
gaugacauagaaaaucccag

SEQ ID NO: 763 - RNA, 20 nt, Artificial Sequence
  Description of Artificial Sequence: Synthetic oligonucleotide
auuuagacauuuuuacagga

SEQ ID NO: 764 - RNA, 20 nt, Artificial Sequence
  Description of Artificial Sequence: Synthetic oligonucleotide
gcgaggugagcccagaggca

SEQ ID NO: 765 - RNA, 20 nt, Artificial Sequence
  Description of Artificial Sequence: Synthetic oligonucleotide
aggcccgaguacuagaggac

SEQ ID NO: 766 - RNA, 20 nt, Artificial Sequence
  Description of Artificial Sequence: Synthetic oligonucleotide
ggggacugacuugagugacc

SEQ ID NO: 767 - RNA, 20 nt, Artificial Sequence
  Description of Artificial Sequence: Synthetic oligonucleotide
cucaaccaucugugagucca

SEQ ID NO: 768 - RNA, 20 nt, Artificial Sequence
  Description of Artificial Sequence: Synthetic oligonucleotide
aucagacuuaauaguccgcg

SEQ ID NO: 769 - RNA, 20 nt, Artificial Sequence
  Description of Artificial Sequence: Synthetic oligonucleotide
aaaguccauuugacaaagcc

SEQ ID NO: 770 - RNA, 20 nt, Artificial Sequence
  Description of Artificial Sequence: Synthetic oligonucleotide
uuucuuucacgcacuccaca

SEQ ID NO: 771 - RNA, 20 nt, Artificial Sequence
  Description of Artificial Sequence: Synthetic oligonucleotide
aaguuuucaaauauuucuga

SEQ ID NO: 772 - RNA, 20 nt, Artificial Sequence
  Description of Artificial Sequence: Synthetic oligonucleotide
ucuugcagccaagucauugu

SEQ ID NO: 773 - RNA, 20 nt, Artificial Sequence
  Description of Artificial Sequence: Synthetic oligonucleotide
gcaccgggagcuaugugaug

SEQ ID NO: 774 - RNA, 20 nt, Artificial Sequence
  Description of Artificial Sequence: Synthetic oligonucleotide
uacuuccgagcuauguuuac

SEQ ID NO: 775 - RNA, 20 nt, Artificial Sequence
  Description of Artificial Sequence: Synthetic oligonucleotide
uagcccucucgucaaugucu

SEQ ID NO: 776 - RNA, 20 nt, Artificial Sequence
  Description of Artificial Sequence: Synthetic oligonucleotide
gcugcagcagggccacguac

SEQ ID NO: 777 - RNA, 20 nt, Artificial Sequence
  Description of Artificial Sequence: Synthetic oligonucleotide
ccuccaugucggcccugucc

SEQ ID NO: 778 - RNA, 20 nt, Artificial Sequence
  Description of Artificial Sequence: Synthetic oligonucleotide
guguugccccuggccagccc

SEQ ID NO: 779 - RNA, 20 nt, Artificial Sequence
  Description of Artificial Sequence: Synthetic oligonucleotide
augucggcccuguccaguac

SEQ ID NO: 780 - RNA, 20 nt, Artificial Sequence
  Description of Artificial Sequence: Synthetic oligonucleotide
cuccucggucagggccgccc

SEQ ID NO: 781 - RNA, 20 nt, Artificial Sequence
  Description of Artificial Sequence: Synthetic oligonucleotide
gcagcaccauguggccccug

SEQ ID NO: 782 - RNA, 20 nt, Artificial Sequence
  Description of Artificial Sequence: Synthetic oligonucleotide
gucccgggugauguugccca

SEQ ID NO: 783 - RNA, 20 nt, Artificial Sequence
  Description of Artificial Sequence: Synthetic oligonucleotide
ugccguuggcguggaagggc

SEQ ID NO: 784 - RNA, 20 nt, Artificial Sequence
  Description of Artificial Sequence: Synthetic oligonucleotide
uguuggggaacggcuccccc

SEQ ID NO: 785 - RNA, 20 nt, Artificial Sequence
  Description of Artificial Sequence: Synthetic oligonucleotide
ugaugcacuuacccuuuuuc

SEQ ID NO: 786 - RNA, 20 nt, Artificial Sequence
  Description of Artificial Sequence: Synthetic oligonucleotide
uaaauguugauaacagccac

SEQ ID NO: 787 - RNA, 20 nt, Artificial Sequence
  Description of Artificial Sequence: Synthetic oligonucleotide
gaaacgaccauccuggaugg

SEQ ID NO: 788 - RNA, 20 nt, Artificial Sequence
  Description of Artificial Sequence: Synthetic oligonucleotide
cccuaggggcucccuggugu

SEQ ID NO: 789 - RNA, 20 nt, Artificial Sequence
  Description of Artificial Sequence: Synthetic oligonucleotide
gaugcaucuuggggugcuga

SEQ ID NO: 790 - RNA, 20 nt, Artificial Sequence
  Description of Artificial Sequence: Synthetic oligonucleotide
cagguggauguuuaccaaug

SEQ ID NO: 791 - RNA, 20 nt, Artificial Sequence
  Description of Artificial Sequence: Synthetic oligonucleotide
uaucacuguccuggcugugc

SEQ ID NO: 792 - RNA, 20 nt, Artificial Sequence
  Description of Artificial Sequence: Synthetic oligonucleotide
ucccuccugcuagcuguggc

SEQ ID NO: 793 - RNA, 20 nt, Artificial Sequence
  Description of Artificial Sequence: Synthetic oligonucleotide
uucagucucaaugggggcac

SEQ ID NO: 794 - RNA, 20 nt, Artificial Sequence
  Description of Artificial Sequence: Synthetic oligonucleotide
augguggccagugcaguuca

SEQ ID NO: 795 - RNA, 20 nt, Artificial Sequence
  Description of Artificial Sequence: Synthetic oligonucleotide
guuuaggcacgcuggcacca

SEQ ID NO: 796 - RNA, 20 nt, Artificial Sequence
  Description of Artificial Sequence: Synthetic oligonucleotide
gaggcaagguauguguugaa

SEQ ID NO: 797 - RNA, 20 nt, Artificial Sequence
  Description of Artificial Sequence: Synthetic oligonucleotide
gcccucacccacgcggaagc

SEQ ID NO: 798 - RNA, 20 nt, Artificial Sequence
  Description of Artificial Sequence: Synthetic oligonucleotide
augacgcucaucggagagaa

SEQ ID NO: 799 - RNA, 20 nt, Artificial Sequence
  Description of Artificial Sequence: Synthetic oligonucleotide
cugcaagcggaccugucuca

SEQ ID NO: 800 - RNA, 20 nt, Artificial Sequence
  Description of Artificial Sequence: Synthetic oligonucleotide
cccuugaucugucacaaugg

SEQ ID NO: 801 - RNA, 20 nt, Artificial Sequence
  Description of Artificial Sequence: Synthetic oligonucleotide
ggccgggggccgggcgcccg

SEQ ID NO: 802 - RNA, 20 nt, Artificial Sequence
  Description of Artificial Sequence: Synthetic oligonucleotide
gugcucgucgucgcgguggu

SEQ ID NO: 803 - RNA, 20 nt, Artificial Sequence
  Description of Artificial Sequence: Synthetic oligonucleotide
caggagaauggcaucagaac

SEQ ID NO: 804 - RNA, 20 nt, Artificial Sequence
  Description of Artificial Sequence: Synthetic oligonucleotide
caggggacuggugggcaggu

SEQ ID NO: 805 - RNA, 20 nt, Artificial Sequence
  Description of Artificial Sequence: Synthetic oligonucleotide
uccauggccaggggacuggu

SEQ ID NO: 806 - RNA, 20 nt, Artificial Sequence
  Description of Artificial Sequence: Synthetic oligonucleotide
cgaccugcccaccagucccc

SEQ ID NO: 807 - RNA, 20 nt, Artificial Sequence
  Description of Artificial Sequence: Synthetic oligonucleotide
uugguguuuacgaugaacau

SEQ ID NO: 808 - RNA, 20 nt, Artificial Sequence
  Description of Artificial Sequence: Synthetic oligonucleotide
cagcagcuggcgcaggccac

SEQ ID NO: 809 - RNA, 20 nt, Artificial Sequence
  Description of Artificial Sequence: Synthetic oligonucleotide
gcgcggaaccccucguccgg

SEQ ID NO: 810 - RNA, 20 nt, Artificial Sequence
  Description of Artificial Sequence: Synthetic oligonucleotide
ggccacgggcaugaugcuuc

SEQ ID NO: 811 - RNA, 20 nt, Artificial Sequence
  Description of Artificial Sequence: Synthetic oligonucleotide
gaacagugccagcuuguuga

SEQ ID NO: 812 - RNA, 20 nt, Artificial Sequence
  Description of Artificial Sequence: Synthetic oligonucleotide
agccgcuguggcccacgauc

SEQ ID NO: 813 - RNA, 20 nt, Artificial Sequence
  Description of Artificial Sequence: Synthetic oligonucleotide
ugacgauuaucacgcuacaa

SEQ ID NO: 814 - RNA, 20 nt, Artificial Sequence
  Description of Artificial Sequence: Synthetic oligonucleotide
uucccggaguggaggagcuu

SEQ ID NO: 815 - RNA, 20 nt, Artificial Sequence
  Description of Artificial Sequence: Synthetic oligonucleotide
aauccucaguaaacuucguc

SEQ ID NO: 816 - RNA, 20 nt, Artificial Sequence
  Description of Artificial Sequence: Synthetic oligonucleotide
gcuggggacgagcgcgcggc

SEQ ID NO: 817 - RNA, 20 nt, Artificial Sequence
  Description of Artificial Sequence: Synthetic oligonucleotide
cuuuaccuuguaggagucgg

SEQ ID NO: 818 - RNA, 20 nt, Artificial Sequence
  Description of Artificial Sequence: Synthetic oligonucleotide
ccggcccgagaugaauccug

SEQ ID NO: 819 - RNA, 20 nt, Artificial Sequence
  Description of Artificial Sequence: Synthetic oligonucleotide
ggccacgggcaugaugcuuc

SEQ ID NO: 820 - RNA, 20 nt, Artificial Sequence
  Description of Artificial Sequence: Synthetic oligonucleotide
gaacagugccagcuuguuga

SEQ ID NO: 821 - RNA, 20 nt, Artificial Sequence
  Description of Artificial Sequence: Synthetic oligonucleotide
agccgcuguggcccacgauc

SEQ ID NO: 822 - RNA, 20 nt, Artificial Sequence
  Description of Artificial Sequence: Synthetic oligonucleotide
uugagcuacacuuguacaau

SEQ ID NO: 823 - RNA, 20 nt, Artificial Sequence
  Description of Artificial Sequence: Synthetic oligonucleotide
cagcucauucauaauggacu

SEQ ID NO: 824 - RNA, 20 nt, Artificial Sequence
  Description of Artificial Sequence: Synthetic oligonucleotide
cagcagggagagcauagaaa

SEQ ID NO: 825 - RNA, 20 nt, Artificial Sequence
  Description of Artificial Sequence: Synthetic oligonucleotide
gccucuuccaccucagacca

SEQ ID NO: 826 - RNA, 20 nt, Artificial Sequence
  Description of Artificial Sequence: Synthetic oligonucleotide
gaguuucaaaucccuuuuau

SEQ ID NO: 827 - RNA, 20 nt, Artificial Sequence
  Description of Artificial Sequence: Synthetic oligonucleotide
cugcagaguccacucuagcu

SEQ ID NO: 828 - RNA, 20 nt, Artificial Sequence
  Description of Artificial Sequence: Synthetic oligonucleotide
ugaccaggccucucuccaag

SEQ ID NO: 829 - RNA, 20 nt, Artificial Sequence
  Description of Artificial Sequence: Synthetic oligonucleotide
gggacaaagugacagugaau

SEQ ID NO: 830 - RNA, 20 nt, Artificial Sequence
  Description of Artificial Sequence: Synthetic oligonucleotide
cugugucgggcuuuggcugg

SEQ ID NO: 831 - RNA, 20 nt, Artificial Sequence
  Description of Artificial Sequence: Synthetic oligonucleotide
gaccaccaccagggcguaga

SEQ ID NO: 832 - RNA, 20 nt, Artificial Sequence
  Description of Artificial Sequence: Synthetic oligonucleotide
ggcggauguggagauagugc

SEQ ID NO: 833 - RNA, 20 nt, Artificial Sequence
  Description of Artificial Sequence: Synthetic oligonucleotide
uuggggucaaagauaggguc

SEQ ID NO: 834 - RNA, 20 nt, Artificial Sequence
  Description of Artificial Sequence: Synthetic oligonucleotide
gcuacaucuacauccaccac

SEQ ID NO: 835 - RNA, 20 nt, Artificial Sequence
  Description of Artificial Sequence: Synthetic oligonucleotide
aaacuuucugugugaaugga

SEQ ID NO: 836 - RNA, 20 nt, Artificial Sequence
  Description of Artificial Sequence: Synthetic oligonucleotide
uuacuugcacaaguaucucg

SEQ ID NO: 837 - RNA, 20 nt, Artificial Sequence
  Description of Artificial Sequence: Synthetic oligonucleotide
uugcagagcagugucucaga

SEQ ID NO: 838 - RNA, 20 nt, Artificial Sequence
  Description of Artificial Sequence: Synthetic oligonucleotide
gcugucgguguaaaaaacca

SEQ ID NO: 839 - RNA, 20 nt, Artificial Sequence
  Description of Artificial Sequence: Synthetic oligonucleotide
ccacaguaacgcccaaugug

SEQ ID NO: 840 - RNA, 20 nt, Artificial Sequence
  Description of Artificial Sequence: Synthetic oligonucleotide
cuuucagacccaccgugcgg

SEQ ID NO: 841 - RNA, 20 nt, Artificial Sequence
  Description of Artificial Sequence: Synthetic oligonucleotide
ucuggugggagggguagucc

SEQ ID NO: 842 - RNA, 20 nt, Artificial Sequence
  Description of Artificial Sequence: Synthetic oligonucleotide
uugaggacaaucuucugguu

SEQ ID NO: 843 - RNA, 20 nt, Artificial Sequence
  Description of Artificial Sequence: Synthetic oligonucleotide
agggcccaggugcuuacaua

SEQ ID NO: 844 - RNA, 20 nt, Artificial Sequence
  Description of Artificial Sequence: Synthetic oligonucleotide
gaucugucugcuucuggagc

SEQ ID NO: 845 - RNA, 20 nt, Artificial Sequence
  Description of Artificial Sequence: Synthetic oligonucleotide
guuuccaagcauggcgagca

SEQ ID NO: 846 - RNA, 20 nt, Artificial Sequence
  Description of Artificial Sequence: Synthetic oligonucleotide
auuacagcaccacugugaag

SEQ ID NO: 847 - RNA, 20 nt, Artificial Sequence
  Description of Artificial Sequence: Synthetic oligonucleotide
cuuuguaagaauaaagaguu

SEQ ID NO: 848 - RNA, 20 nt, Artificial Sequence
  Description of Artificial Sequence: Synthetic oligonucleotide
gagcaacuggaguuccuggg

SEQ ID NO: 849 - RNA, 20 nt, Artificial Sequence
  Description of Artificial Sequence: Synthetic oligonucleotide
uagauuaaggucaccguugc

SEQ ID NO: 850 - RNA, 20 nt, Artificial Sequence
  Description of Artificial Sequence: Synthetic oligonucleotide
caggacaaaugaccacauca

SEQ ID NO: 851 - RNA, 20 nt, Artificial Sequence
  Description of Artificial Sequence: Synthetic oligonucleotide
cauggaguuauuccuucaua

SEQ ID NO: 852 - RNA, 20 nt, Artificial Sequence
  Description of Artificial Sequence: Synthetic oligonucleotide
caacugcaaaguuugcuguc

SEQ ID NO: 853 - RNA, 20 nt, Artificial Sequence
  Description of Artificial Sequence: Synthetic oligonucleotide
ccccaccgucgcgcuccucc

SEQ ID NO: 854 - RNA, 20 nt, Artificial Sequence
  Description of Artificial Sequence: Synthetic oligonucleotide
cagcucagaaucuugcugcu

SEQ ID NO: 855 - RNA, 20 nt, Artificial Sequence
  Description of Artificial Sequence: Synthetic oligonucleotide
ugugagggcuggcagcggcg

SEQ ID NO: 856 - RNA, 20 nt, Artificial Sequence
  Description of Artificial Sequence: Synthetic oligonucleotide
guggcaggagcagcaacccc

SEQ ID NO: 857 - RNA, 20 nt, Artificial Sequence
  Description of Artificial Sequence: Synthetic oligonucleotide
cgcagcaugagcuccgcagc

SEQ ID NO: 858 - RNA, 20 nt, Artificial Sequence
  Description of Artificial Sequence: Synthetic oligonucleotide
ggcgcgggugaggcgggacc

SEQ ID NO: 859 - RNA, 20 nt, Artificial Sequence
  Description of Artificial Sequence: Synthetic oligonucleotide
agagcagaaaccaggcuggg

SEQ ID NO: 860 - RNA, 20 nt, Artificial Sequence
  Description of Artificial Sequence: Synthetic oligonucleotide
agagcagaaaccaggcuggg

SEQ ID NO: 861 - RNA, 20 nt, Artificial Sequence
  Description of Artificial Sequence: Synthetic oligonucleotide
cgauaccaccacauagcgua

SEQ ID NO: 862 - RNA, 20 nt, Artificial Sequence
  Description of Artificial Sequence: Synthetic oligonucleotide
cagggccuuccacucguucc

SEQ ID NO: 863 - RNA, 20 nt, Artificial Sequence
  Description of Artificial Sequence: Synthetic oligonucleotide
gccgcucuaugcugcuugcc

SEQ ID NO: 864 - RNA, 20 nt, Artificial Sequence
  Description of Artificial Sequence: Synthetic oligonucleotide
acccuuccagauauuaugcc

SEQ ID NO: 865 - RNA, 20 nt, Artificial Sequence
  Description of Artificial Sequence: Synthetic oligonucleotide
accgacagggaggaguagcc

SEQ ID NO: 866 - RNA, 20 nt, Artificial Sequence
  Description of Artificial Sequence: Synthetic oligonucleotide
ggaccccuucucacacucca

SEQ ID NO: 867 - RNA, 20 nt, Artificial Sequence
  Description of Artificial Sequence: Synthetic oligonucleotide
uuggcgaaaggcaaagguag

SEQ ID NO: 868 - RNA, 20 nt, Artificial Sequence
  Description of Artificial Sequence: Synthetic oligonucleotide
gucauugcugcugacugcuc

SEQ ID NO: 869 - RNA, 20 nt, Artificial Sequence
  Description of Artificial Sequence: Synthetic oligonucleotide
aaggggugguaucaagucug

SEQ ID NO: 870 - RNA, 20 nt, Artificial Sequence
  Description of Artificial Sequence: Synthetic oligonucleotide
accacaguucagcucuuccg

SEQ ID NO: 871 - RNA, 20 nt, Artificial Sequence
  Description of Artificial Sequence: Synthetic oligonucleotide
gcgucugggauauucacaga

SEQ ID NO: 872 - RNA, 20 nt, Artificial Sequence
  Description of Artificial Sequence: Synthetic oligonucleotide
acugcgacugugaaauccug

SEQ ID NO: 873 - RNA, 20 nt, Artificial Sequence
  Description of Artificial Sequence: Synthetic oligonucleotide
ccgcguuacagcgcuggcuc

SEQ ID NO: 874 - RNA, 20 nt, Artificial Sequence
  Description of Artificial Sequence: Synthetic oligonucleotide
aguaggccgcguuacagcgc

SEQ ID NO: 875 - RNA, 20 nt, Artificial Sequence
  Description of Artificial Sequence: Synthetic oligonucleotide
cugcugacgggugcaggagu

SEQ ID NO: 876 - RNA, 20 nt, Artificial Sequence
  Description of Artificial Sequence: Synthetic oligonucleotide
gcaguucugcugacgggugc

SEQ ID NO: 877 - RNA, 20 nt, Artificial Sequence
  Description of Artificial Sequence: Synthetic oligonucleotide
agcccugaucauuucaggac

SEQ ID NO: 878 - RNA, 20 nt, Artificial Sequence
  Description of Artificial Sequence: Synthetic oligonucleotide
cugguucuuucugaagcagc

SEQ ID NO: 879 - RNA, 20 nt, Artificial Sequence
  Description of Artificial Sequence: Synthetic oligonucleotide
uggcugaagcaaagacccac

SEQ ID NO: 880 - RNA, 20 nt, Artificial Sequence
  Description of Artificial Sequence: Synthetic oligonucleotide
ccucuaugaggugguucacg

SEQ ID NO: 881 - RNA, 20 nt, Artificial Sequence
  Description of Artificial Sequence: Synthetic oligonucleotide
ggugccgaggggguuggcca

SEQ ID NO: 882 - RNA, 20 nt, Artificial Sequence
  Description of Artificial Sequence: Synthetic oligonucleotide
ugcagcugcugcuuucuuag

SEQ ID NO: 883 - RNA, 20 nt, Artificial Sequence
  Description of Artificial Sequence: Synthetic oligonucleotide
acagcccagcaugggagucc

SEQ ID NO: 884 - RNA, 20 nt, Artificial Sequence
  Description of Artificial Sequence: Synthetic oligonucleotide
cuggagcugccagccguccc

SEQ ID NO: 885 - RNA, 20 nt, Artificial Sequence
  Description of Artificial Sequence: Synthetic oligonucleotide
cuugauguugacaugggaga

SEQ ID NO: 886 - RNA, 20 nt, Artificial Sequence
  Description of Artificial Sequence: Synthetic oligonucleotide
cccugacuccagugcaccca

SEQ ID NO: 887 - RNA, 20 nt, Artificial Sequence
  Description of Artificial Sequence: Synthetic oligonucleotide
cgucaccagcguggucaugc

SEQ ID NO: 888 - RNA, 20 nt, Artificial Sequence
  Description of Artificial Sequence: Synthetic oligonucleotide
cuugcagguguagcacuuga

SEQ ID NO: 889 - RNA, 20 nt, Artificial Sequence
  Description of Artificial Sequence: Synthetic oligonucleotide
aucaagccagaaauggaggc

SEQ ID NO: 890 - RNA, 20 nt, Artificial Sequence
  Description of Artificial Sequence: Synthetic oligonucleotide
agaaauccuuuauucacaug

SEQ ID NO: 891 - RNA, 20 nt, Artificial Sequence
  Description of Artificial Sequence: Synthetic oligonucleotide
uuaggaugcaugcaagggga

SEQ ID NO: 892 - RNA, 20 nt, Artificial Sequence
  Description of Artificial Sequence: Synthetic oligonucleotide
ucugagaguccauuuucagg

SEQ ID NO: 893 - RNA, 20 nt, Artificial Sequence
  Description of Artificial Sequence: Synthetic oligonucleotide
agugacaaagaugauucgcu

SEQ ID NO: 894 - RNA, 20 nt, Artificial Sequence
  Description of Artificial Sequence: Synthetic oligonucleotide
acccagucagucuuaccugu

SEQ ID NO: 895 - RNA, 20 nt, Artificial Sequence
  Description of Artificial Sequence: Synthetic oligonucleotide
gucccccacagaccauuacu

SEQ ID NO: 896 - RNA, 20 nt, Artificial Sequence
  Description of Artificial Sequence: Synthetic oligonucleotide
ggggguggaagucccaguaa

SEQ ID NO: 897 - RNA, 20 nt, Artificial Sequence
  Description of Artificial Sequence: Synthetic oligonucleotide
cgcugugcacgugguggggg

SEQ ID NO: 898 - RNA, 20 nt, Artificial Sequence
  Description of Artificial Sequence: Synthetic oligonucleotide
acucgcugugcacguggugg

SEQ ID NO: 899 - RNA, 20 nt, Artificial Sequence
  Description of Artificial Sequence: Synthetic oligonucleotide
aauggugagacucaucagac

SEQ ID NO: 900 - RNA, 20 nt, Artificial Sequence
  Description of Artificial Sequence: Synthetic oligonucleotide
ucgguugcuggcagguccgu

SEQ ID NO: 901 - RNA, 20 nt, Artificial Sequence
  Description of Artificial Sequence: Synthetic oligonucleotide
ugauggccgaggugauagug

SEQ ID NO: 902 - RNA, 20 nt, Artificial Sequence
  Description of Artificial Sequence: Synthetic oligonucleotide
cccgccccggaugggcaucg

SEQ ID NO: 903 - RNA, 20 nt, Artificial Sequence
  Description of Artificial Sequence: Synthetic oligonucleotide
ggcaucguggagccggguug

SEQ ID NO: 904 - RNA, 20 nt, Artificial Sequence
  Description of Artificial Sequence: Synthetic oligonucleotide
ggguugcggagacaugcuga

SEQ ID NO: 905 - RNA, 20 nt, Artificial Sequence
  Description of Artificial Sequence: Synthetic oligonucleotide
gucgcuccccggcaucggcu

SEQ ID NO: 906 - RNA, 20 nt, Artificial Sequence
  Description of Artificial Sequence: Synthetic oligonucleotide
gcacugccccugcugguggu

SEQ ID NO: 907 - RNA, 20 nt, Artificial Sequence
  Description of Artificial Sequence: Synthetic oligonucleotide
aguaccagcugcccuaccag

SEQ ID NO: 908 - RNA, 20 nt, Artificial Sequence
  Description of Artificial Sequence: Synthetic oligonucleotide
cuccuugguggcgcccaucu

SEQ ID NO: 909 - RNA, 20 nt, Artificial Sequence
  Description of Artificial Sequence: Synthetic oligonucleotide
gccgcagcuuggacaggauc

SEQ ID NO: 910 - RNA, 20 nt, Artificial Sequence
  Description of Artificial Sequence: Synthetic oligonucleotide
cuccaugucgauagucuugc

SEQ ID NO: 911 - RNA, 20 nt, Artificial Sequence
  Description of Artificial Sequence: Synthetic oligonucleotide
agcagccgcagcccggaggg

SEQ ID NO: 912 - RNA, 20 nt, Artificial Sequence
  Description of Artificial Sequence: Synthetic oligonucleotide
uaccugcagcacacucgaua

SEQ ID NO: 913 - RNA, 20 nt, Artificial Sequence
  Description of Artificial Sequence: Synthetic oligonucleotide
ucgggcucaggauagucuuc

SEQ ID NO: 914 - RNA, 20 nt, Artificial Sequence
  Description of Artificial Sequence: Synthetic oligonucleotide
cuucuccuggagcaaguccc

SEQ ID NO: 915 - RNA, 20 nt, Artificial Sequence
  Description of Artificial Sequence: Synthetic oligonucleotide
gacagaucuugagcaagcuc

SEQ ID NO: 916 - RNA, 20 nt, Artificial Sequence
  Description of Artificial Sequence: Synthetic oligonucleotide
uggugcaaguggacagagag

SEQ ID NO: 917 - RNA, 20 nt, Artificial Sequence
  Description of Artificial Sequence: Synthetic oligonucleotide
gcacuugcaaagggcucugg

SEQ ID NO: 918 - RNA, 20 nt, Artificial Sequence
  Description of Artificial Sequence: Synthetic oligonucleotide
uuuucaguaaagucaucacc

SEQ ID NO: 919 - RNA, 20 nt, Artificial Sequence
  Description of Artificial Sequence: Synthetic oligonucleotide
cugcaucucacucauguuga

SEQ ID NO: 920 - RNA, 20 nt, Artificial Sequence
  Description of Artificial Sequence: Synthetic oligonucleotide
ccucuucauuuggcacucga

SEQ ID NO: 921 - RNA, 20 nt, Artificial Sequence
  Description of Artificial Sequence: Synthetic oligonucleotide
ucuacugcuaccgcguuaac

SEQ ID NO: 922 - RNA, 20 nt, Artificial Sequence
  Description of Artificial Sequence: Synthetic oligonucleotide
cgagcacugugccaucaucc

SEQ ID NO: 923 - RNA, 20 nt, Artificial Sequence
  Description of Artificial Sequence: Synthetic oligonucleotide
guugauguuguuggcacacg

SEQ ID NO: 924 - RNA, 20 nt, Artificial Sequence
  Description of Artificial Sequence: Synthetic oligonucleotide
cagcccaguugugccucugc

SEQ ID NO: 925 - RNA, 20 nt, Artificial Sequence
  Description of Artificial Sequence: Synthetic oligonucleotide
caucaaggccuggacaggau

SEQ ID NO: 926 - RNA, 20 nt, Artificial Sequence
  Description of Artificial Sequence: Synthetic oligonucleotide
cccuuggcagguccagagcc

SEQ ID NO: 927 - RNA, 20 nt, Artificial Sequence
  Description of Artificial Sequence: Synthetic oligonucleotide
uccugucuaacagagucugg

SEQ ID NO: 928 - RNA, 20 nt, Artificial Sequence
  Description of Artificial Sequence: Synthetic oligonucleotide
gucggcgcccagaccccuug

SEQ ID NO: 929 - RNA, 20 nt, Artificial Sequence
  Description of Artificial Sequence: Synthetic oligonucleotide
ucagguuggcauccucgaug

SEQ ID NO: 930 - RNA, 20 nt, Artificial Sequence
  Description of Artificial Sequence: Synthetic oligonucleotide
gagaagugguccaucugucc

SEQ ID NO: 931 - RNA, 20 nt, Artificial Sequence
  Description of Artificial Sequence: Synthetic oligonucleotide
uggcgucacauaugcauuua

SEQ ID NO: 932 - RNA, 20 nt, Artificial Sequence
  Description of Artificial Sequence: Synthetic oligonucleotide
ucuucuccaggaaguacugc

SEQ ID NO: 933 - RNA, 20 nt, Artificial Sequence
  Description of Artificial Sequence: Synthetic oligonucleotide
ccuguccagaaagcugcccc

SEQ ID NO: 934 - RNA, 20 nt, Artificial Sequence
  Description of Artificial Sequence: Synthetic oligonucleotide
ccaucacucccuccagcaga

SEQ ID NO: 935 - RNA, 20 nt, Artificial Sequence
  Description of Artificial Sequence: Synthetic oligonucleotide
ucuuucucaggaggagacca

SEQ ID NO: 936 - RNA, 20 nt, Artificial Sequence
  Description of Artificial Sequence: Synthetic oligonucleotide
caggggcucaaagggggcca

SEQ ID NO: 937 - RNA, 20 nt, Artificial Sequence
  Description of Artificial Sequence: Synthetic oligonucleotide
gacacaggugcaggcccugc

SEQ ID NO: 938 - RNA, 20 nt, Artificial Sequence
  Description of Artificial Sequence: Synthetic oligonucleotide
gggugaggacucaccgaggu

SEQ ID NO: 939 - RNA, 20 nt, Artificial Sequence
  Description of Artificial Sequence: Synthetic oligonucleotide
gaucaugcuuucagugcuca

SEQ ID NO: 940 - RNA, 20 nt, Artificial Sequence
  Description of Artificial Sequence: Synthetic oligonucleotide
caagaagacaggggggcccc

SEQ ID NO: 941 - RNA, 20 nt, Artificial Sequence
  Description of Artificial Sequence: Synthetic oligonucleotide
ggcgccugccacgaucagga

SEQ ID NO: 942 - RNA, 20 nt, Artificial Sequence
  Description of Artificial Sequence: Synthetic oligonucleotide
ccggccccugcucaggaagu

SEQ ID NO: 943 - RNA, 20 nt, Artificial Sequence
  Description of Artificial Sequence: Synthetic oligonucleotide
ugagcggaagcagcugugca

SEQ ID NO: 944 - RNA, 20 nt, Artificial Sequence
  Description of Artificial Sequence: Synthetic oligonucleotide
gcagcugugcacggccacac

SEQ ID NO: 945 - RNA, 20 nt, Artificial Sequence
  Description of Artificial Sequence: Synthetic oligonucleotide
gcggcagacuguguccugug

SEQ ID NO: 946 - RNA, 20 nt, Artificial Sequence
  Description of Artificial Sequence: Synthetic oligonucleotide
gucucccgcaggcaaggccc

SEQ ID NO: 947 - RNA, 20 nt, Artificial Sequence
  Description of Artificial Sequence: Synthetic oligonucleotide
cccccggcgcugcgcgugca

SEQ ID NO: 948 - RNA, 20 nt, Artificial Sequence
  Description of Artificial Sequence: Synthetic oligonucleotide
ccgcaacaccgagugcgcgc

SEQ ID NO: 949 - RNA, 20 nt, Artificial Sequence
  Description of Artificial Sequence: Synthetic oligonucleotide
gccagcugucuguguaguag

SEQ ID NO: 950 - RNA, 20 nt, Artificial Sequence
  Description of Artificial Sequence: Synthetic oligonucleotide
aacaacacuguacagcaaag

SEQ ID NO: 951 - RNA, 20 nt, Artificial Sequence
  Description of Artificial Sequence: Synthetic oligonucleotide
acuuuggaggaaacguuucc

SEQ ID NO: 952 - RNA, 20 nt, Artificial Sequence
  Description of Artificial Sequence: Synthetic oligonucleotide
agcaaaucgaauuauuuuga

SEQ ID NO: 953 - RNA, 20 nt, Artificial Sequence
  Description of Artificial Sequence: Synthetic oligonucleotide
uucucccuguccccuaggug

SEQ ID NO: 954 - RNA, 20 nt, Artificial Sequence
  Description of Artificial Sequence: Synthetic oligonucleotide
ccaggugcuccuggagcugu

SEQ ID NO: 955 - RNA, 20 nt, Artificial Sequence
  Description of Artificial Sequence: Synthetic oligonucleotide
ugugaacaggauuguaaaca

SEQ ID NO: 956 - RNA, 20 nt, Artificial Sequence
  Description of Artificial Sequence: Synthetic oligonucleotide
cagagugugacugcacucca

SEQ ID NO: 957 - RNA, 20 nt, Artificial Sequence
  Description of Artificial Sequence: Synthetic oligonucleotide
gggacuuuguagguguuuuc

SEQ ID NO: 958 - RNA, 20 nt, Artificial Sequence
  Description of Artificial Sequence: Synthetic oligonucleotide
gggguccagugaagcgucag

SEQ ID NO: 959 - RNA, 20 nt, Artificial Sequence
  Description of Artificial Sequence: Synthetic oligonucleotide
auacgccucugacgcuucac

SEQ ID NO: 960 - RNA, 20 nt, Artificial Sequence
  Description of Artificial Sequence: Synthetic oligonucleotide
cgggaggccacggggcuucg

SEQ ID NO: 961 - RNA, 20 nt, Artificial Sequence
  Description of Artificial Sequence: Synthetic oligonucleotide
cacuggaccccgaagccccg

SEQ ID NO: 962 - RNA, 20 nt, Artificial Sequence
  Description of Artificial Sequence: Synthetic oligonucleotide
cuaccuuucuaacgagcuga

SEQ ID NO: 963 - RNA, 20 nt, Artificial Sequence
  Description of Artificial Sequence: Synthetic oligonucleotide
guucauacucucuucgucau

SEQ ID NO: 964 - RNA, 20 nt, Artificial Sequence
  Description of Artificial Sequence: Synthetic oligonucleotide
gaaacaagcaaugccacuuu

SEQ ID NO: 965 - RNA, 20 nt, Artificial Sequence
  Description of Artificial Sequence: Synthetic oligonucleotide
ccaucuucugauauucuauu

SEQ ID NO: 966 - RNA, 20 nt, Artificial Sequence
  Description of Artificial Sequence: Synthetic oligonucleotide
agauuuucaagacacaacuc

SEQ ID NO: 967 - RNA, 20 nt, Artificial Sequence
  Description of Artificial Sequence: Synthetic oligonucleotide
uucauguaggagaauuaaac

SEQ ID NO: 968 - RNA, 20 nt, Artificial Sequence
  Description of Artificial Sequence: Synthetic oligonucleotide
ccgcccccauggccgcccgu

SEQ ID NO: 969 - RNA, 20 nt, Artificial Sequence
  Description of Artificial Sequence: Synthetic oligonucleotide
ccugcuggucccgcucgcgc

SEQ ID NO: 970 - RNA, 20 nt, Artificial Sequence
  Description of Artificial Sequence: Synthetic oligonucleotide
ccgggcaucgcuguccgccc

SEQ ID NO: 971 - RNA, 20 nt, Artificial Sequence
  Description of Artificial Sequence: Synthetic oligonucleotide
ccgcccccauggccgcccgu

SEQ ID NO: 972 - RNA, 20 nt, Artificial Sequence
  Description of Artificial Sequence: Synthetic oligonucleotide
ccugcuggucccgcucgcgc

SEQ ID NO: 973 - RNA, 20 nt, Artificial Sequence
  Description of Artificial Sequence: Synthetic oligonucleotide
ccgggcaucgcuguccgccc

SEQ ID NO: 974 - RNA, 20 nt, Artificial Sequence
  Description of Artificial Sequence: Synthetic oligonucleotide
ggggggcccagucagagagc

SEQ ID NO: 975 - RNA, 20 nt, Artificial Sequence
  Description of Artificial Sequence: Synthetic oligonucleotide
cagagccauggcacaagcca

SEQ ID NO: 976 - RNA, 20 nt, Artificial Sequence
  Description of Artificial Sequence: Synthetic oligonucleotide
agagaggugagccggcugca

SEQ ID NO: 977 - RNA, 20 nt, Artificial Sequence
  Description of Artificial Sequence: Synthetic oligonucleotide
ucauuucuucucuuuucuua

SEQ ID NO: 978 - RNA, 20 nt, Artificial Sequence
  Description of Artificial Sequence: Synthetic oligonucleotide
cuccaaagacggaaagcugc

SEQ ID NO: 979 - RNA, 20 nt, Artificial Sequence
  Description of Artificial Sequence: Synthetic oligonucleotide
cacgguggugucuuucuacc

SEQ ID NO: 980 - RNA, 20 nt, Artificial Sequence
  Description of Artificial Sequence: Synthetic oligonucleotide
cacaccgcccagcugcaccu

SEQ ID NO: 981 - RNA, 20 nt, Artificial Sequence
  Description of Artificial Sequence: Synthetic oligonucleotide
gggccccaucgugguagcug

SEQ ID NO: 982 - RNA, 20 nt, Artificial Sequence
  Description of Artificial Sequence: Synthetic oligonucleotide
gcugccggucaagcuggagu

SEQ ID NO: 983 - RNA, 20 nt, Artificial Sequence
  Description of Artificial Sequence: Synthetic oligonucleotide
ucaucccacggaaugugacc

SEQ ID NO: 984 - RNA, 20 nt, Artificial Sequence
  Description of Artificial Sequence: Synthetic oligonucleotide
auuuguugguauaguucauu

SEQ ID NO: 985 - RNA, 20 nt, Artificial Sequence
  Description of Artificial Sequence: Synthetic oligonucleotide
ugauuuuuaaagugcugugu

SEQ ID NO: 986 - RNA, 20 nt, Artificial Sequence
  Description of Artificial Sequence: Synthetic oligonucleotide
aauaaagauuagccaacuga

SEQ ID NO: 987 - RNA, 20 nt, Artificial Sequence
  Description of Artificial Sequence: Synthetic oligonucleotide
gcaaaagagccacagcuucc

SEQ ID NO: 988 - RNA, 20 nt, Artificial Sequence
  Description of Artificial Sequence: Synthetic oligonucleotide
aaguggcucaaacacauuuu

SEQ ID NO: 989 - RNA, 20 nt, Artificial Sequence
  Description of Artificial Sequence: Synthetic oligonucleotide
ccucauccuucugguaauga

SEQ ID NO: 990 - RNA, 20 nt, Artificial Sequence
  Description of Artificial Sequence: Synthetic oligonucleotide
guuuuaucucaucucccuga

SEQ ID NO: 991 - RNA, 20 nt, Artificial Sequence
  Description of Artificial Sequence: Synthetic oligonucleotide
cuagaauauaagaaggagaa

SEQ ID NO: 992 - RNA, 20 nt, Artificial Sequence
  Description of Artificial Sequence: Synthetic oligonucleotide
ucugugccuugucuucacgg

SEQ ID NO: 993 - RNA, 20 nt, Artificial Sequence
  Description of Artificial Sequence: Synthetic oligonucleotide
gcucgugguccccagguggc

SEQ ID NO: 994 - RNA, 20 nt, Artificial Sequence
  Description of Artificial Sequence: Synthetic oligonucleotide
ugagugcuugcugcagcccu

SEQ ID NO: 995 - RNA, 20 nt, Artificial Sequence
  Description of Artificial Sequence: Synthetic oligonucleotide
auacgccucugacgcuucac

SEQ ID NO: 996 - RNA, 20 nt, Artificial Sequence
  Description of Artificial Sequence: Synthetic oligonucleotide
acgcggcaggcgcgagcgcg

SEQ ID NO: 997 - RNA, 20 nt, Artificial Sequence
  Description of Artificial Sequence: Synthetic oligonucleotide
cgucuuccucgccugccccu

SEQ ID NO: 998 - RNA, 20 nt, Artificial Sequence
  Description of Artificial Sequence: Synthetic oligonucleotide
cuccucggagaagcuuggca

SEQ ID NO: 999 - RNA, 20 nt, Artificial Sequence
  Description of Artificial Sequence: Synthetic oligonucleotide
ggucacccagcccagauucu

SEQ ID NO: 1000 - RNA, 20 nt, Artificial Sequence
  Description of Artificial Sequence: Synthetic oligonucleotide
agccucccagauggcugagu

SEQ ID NO: 1001 - RNA, 20 nt, Artificial Sequence
  Description of Artificial Sequence: Synthetic oligonucleotide
uggauuucaguaaggcaaug

SEQ ID NO: 1002 - RNA, 20 nt, Artificial Sequence
  Description of Artificial Sequence: Synthetic oligonucleotide
aauguucgccaugaaaacua

SEQ ID NO: 1003 - RNA, 20 nt, Artificial Sequence
  Description of Artificial Sequence: Synthetic oligonucleotide
caagguacagcaaacgucug

SEQ ID NO: 1004 - RNA, 20 nt, Artificial Sequence
  Description of Artificial Sequence: Synthetic oligonucleotide
gugagugcccggaagagaga

SEQ ID NO: 1005 - RNA, 20 nt, Artificial Sequence
  Description of Artificial Sequence: Synthetic oligonucleotide
ugugaaaguucuucugcaac

SEQ ID NO: 1006 - RNA, 20 nt, Artificial Sequence
  Description of Artificial Sequence: Synthetic oligonucleotide
acagacacauucugguggug

SEQ ID NO: 1007 - RNA, 20 nt, Artificial Sequence
  Description of Artificial Sequence: Synthetic oligonucleotide
uaaccaggggggccccggcg

SEQ ID NO: 1008 - RNA, 20 nt, Artificial Sequence
  Description of Artificial Sequence: Synthetic oligonucleotide
agagaagucccggaccuaug

SEQ ID NO: 1009 - RNA, 20 nt, Artificial Sequence
  Description of Artificial Sequence: Synthetic oligonucleotide
uguguuuggaucccccuugg

SEQ ID NO: 1010 - RNA, 20 nt, Artificial Sequence
  Description of Artificial Sequence: Synthetic oligonucleotide
ggcagcuuugccggccugcc

SEQ ID NO: 1011 - RNA, 20 nt, Artificial Sequence
  Description of Artificial Sequence: Synthetic oligonucleotide
acucgccaaccucagcaacc

SEQ ID NO: 1012 - RNA, 20 nt, Artificial Sequence
  Description of Artificial Sequence: Synthetic oligonucleotide
augagaccuuccguggccug

SEQ ID NO: 1013 - RNA, 20 nt, Artificial Sequence
  Description of Artificial Sequence: Synthetic oligonucleotide
caggggccggagcccgcgcc

SEQ ID NO: 1014 - RNA, 20 nt, Artificial Sequence
  Description of Artificial Sequence: Synthetic oligonucleotide
uucucgcuucggaggagccg

SEQ ID NO: 1015 - RNA, 20 nt, Artificial Sequence
  Description of Artificial Sequence: Synthetic oligonucleotide
aagugcuagcucgggccggg

SEQ ID NO: 1016 - RNA, 20 nt, Artificial Sequence
  Description of Artificial Sequence: Synthetic oligonucleotide
cgaagcugaauuccccuuca

SEQ ID NO: 1017 - RNA, 20 nt, Artificial Sequence
  Description of Artificial Sequence: Synthetic oligonucleotide
ugcgcaaggugaacgacucu

SEQ ID NO: 1018 - RNA, 20 nt, Artificial Sequence
  Description of Artificial Sequence: Synthetic oligonucleotide
uucaaccaccgagcugggcc

SEQ ID NO: 1019 - RNA, 20 nt, Artificial Sequence
  Description of Artificial Sequence: Synthetic oligonucleotide
gcuccuucucacagcggucg

SEQ ID NO: 1020 - RNA, 20 nt, Artificial Sequence
  Description of Artificial Sequence: Synthetic oligonucleotide
ccgcugcuauauggacgccg

SEQ ID NO: 1021 - RNA, 20 nt, Artificial Sequence
  Description of Artificial Sequence: Synthetic oligonucleotide
ccugcaagcacgugcucagc

SEQ ID NO: 1022 - RNA, 20 nt, Artificial Sequence
  Description of Artificial Sequence: Synthetic oligonucleotide
gugcaaagaccgcugugaga

SEQ ID NO: 1023 - RNA, 20 nt, Artificial Sequence
  Description of Artificial Sequence: Synthetic oligonucleotide
ccgcugcuacauggaugccg

SEQ ID NO: 1024 - RNA, 20 nt, Artificial Sequence
  Description of Artificial Sequence: Synthetic oligonucleotide
ccugccgcuaucacuucacc

SEQ ID NO: 1025 - RNA, 20 nt, Artificial Sequence
  Description of Artificial Sequence: Synthetic oligonucleotide
agacuccaagagucugcaac

SEQ ID NO: 1026 - RNA, 20 nt, Artificial Sequence
  Description of Artificial Sequence: Synthetic oligonucleotide
gcgucugauacgccaaaauc

SEQ ID NO: 1027 - RNA, 20 nt, Artificial Sequence
  Description of Artificial Sequence: Synthetic oligonucleotide
ggcaguuccggaaucgccgc

SEQ ID NO: 1028 - RNA, 20 nt, Artificial Sequence
  Description of Artificial Sequence: Synthetic oligonucleotide
uguugcaauuccagcggugc

SEQ ID NO: 1029 - RNA, 20 nt, Artificial Sequence
  Description of Artificial Sequence: Synthetic oligonucleotide
cuaauggcacgcaucacauc

SEQ ID NO: 1030 - RNA, 20 nt, Artificial Sequence
  Description of Artificial Sequence: Synthetic oligonucleotide
gagcuacagguggcuccucc

SEQ ID NO: 1031 - RNA, 20 nt, Artificial Sequence
  Description of Artificial Sequence: Synthetic oligonucleotide
ugcaguuccaccuucgaugu

SEQ ID NO: 1032 - RNA, 20 nt, Artificial Sequence
  Description of Artificial Sequence: Synthetic oligonucleotide
cuucuccgauguacugcaug

SEQ ID NO: 1033 - RNA, 20 nt, Artificial Sequence
  Description of Artificial Sequence: Synthetic oligonucleotide
ccugccaguuggcugcagag

SEQ ID NO: 1034 - RNA, 20 nt, Artificial Sequence
  Description of Artificial Sequence: Synthetic oligonucleotide
agagcgcaccgucuucggga

SEQ ID NO: 1035 - RNA, 20 nt, Artificial Sequence
  Description of Artificial Sequence: Synthetic oligonucleotide
acugaaacugacacucgucc

SEQ ID NO: 1036 - RNA, 20 nt, Artificial Sequence
  Description of Artificial Sequence: Synthetic oligonucleotide
uggcagaucgcccgcugucu

SEQ ID NO: 1037 - RNA, 20 nt, Artificial Sequence
  Description of Artificial Sequence: Synthetic oligonucleotide
ggagugaagucucagauaag

SEQ ID NO: 1038 - RNA, 20 nt, Artificial Sequence
  Description of Artificial Sequence: Synthetic oligonucleotide
ggagugaagucucagauaag

SEQ ID NO: 1039 - RNA, 20 nt, Artificial Sequence
  Description of Artificial Sequence: Synthetic oligonucleotide
ggagugaagucucagauaag

SEQ ID NO: 1040 - RNA, 20 nt, Artificial Sequence
  Description of Artificial Sequence: Synthetic oligonucleotide
gaguguauuucuauaccucu

SEQ ID NO: 1041 - RNA, 20 nt, Artificial Sequence
  Description of Artificial Sequence: Synthetic oligonucleotide
uagggagugaagucucacau

SEQ ID NO: 1042 - RNA, 20 nt, Artificial Sequence
  Description of Artificial Sequence: Synthetic oligonucleotide
uagggagugaagucucacau

SEQ ID NO: 1043 - RNA, 20 nt, Artificial Sequence
  Description of Artificial Sequence: Synthetic oligonucleotide
ccuccauggucggauggcac

SEQ ID NO: 1044 - RNA, 20 nt, Artificial Sequence
  Description of Artificial Sequence: Synthetic oligonucleotide
ucggaggggcucaggcucca

SEQ ID NO: 1045 - RNA, 20 nt, Artificial Sequence
  Description of Artificial Sequence: Synthetic oligonucleotide
ggagggccgcagcuguggcu

SEQ ID NO: 1046 - DNA, 58 bp, Artificial Sequence
  Description of Artificial Sequence: Synthetic oligonucleotide
ccggaggcgtccctataccaaataactcgagttatttggtatagggacgccttttttg

SEQ ID NO: 1047 - DNA, 58 bp, Artificial Sequence
  Description of Artificial Sequence: Synthetic oligonucleotide
ccggagactgcatcaatcgtcataactcgagttatgacgattgatgcagtcttttttg

SEQ ID NO: 1048 - DNA, 58 bp, Artificial Sequence
  Description of Artificial Sequence: Synthetic oligonucleotide
ccggcctccagacatccttgaaatactcgagtatttcaaggatgtctggaggtttttg

SEQ ID NO: 1049 - DNA, 58 bp, Artificial Sequence
  Description of Artificial Sequence: Synthetic oligonucleotide
ccggatcctgtgggcctggtttattctcgagaataaaccaggcccacaggattttttg

SEQ ID NO: 1050 - DNA, 58 bp, Artificial Sequence
  Description of Artificial Sequence: Synthetic oligonucleotide
ccggtggcagaagccctggcaatttctcgagaaattgccagggcttctgccatttttg

SEQ ID NO: 1051 - DNA, 58 bp, Artificial Sequence
  Description of Artificial Sequence: Synthetic oligonucleotide
ccggggcggatggttgagatctatcctcgaggatagatctcaaccatccgcctttttg

SEQ ID NO: 1052 - DNA, 58 bp, Artificial Sequence
  Description of Artificial Sequence: Synthetic oligonucleotide
ccgggagcactctttatactattaactcgagttaatagtataaagagtgctctttttg

SEQ ID NO: 1053 - DNA, 58 bp, Artificial Sequence
  Description of Artificial Sequence: Synthetic oligonucleotide
ccgggtggaactgccacgcagatttctcgagaaatctgcgtggcagttccactttttg

SEQ ID NO: 1054 - DNA, 58 bp, Artificial Sequence
  Description of Artificial Sequence: Synthetic oligonucleotide
ccggcattgggtcttcgggagtttcctcgaggaaactcccgaagacccaatgtttttg

SEQ ID NO: 1055 - DNA, 58 bp, Artificial Sequence
  Description of Artificial Sequence: Synthetic oligonucleotide
ccggcactattggtgtaccttataactcgagttataaggtacaccaatagtgtttttg

SEQ ID NO: 1056 - DNA, 58 bp, Artificial Sequence
  Description of Artificial Sequence: Synthetic oligonucleotide
ccggggcatagtgctgacatatattctcgagaatatatgtcagcactatgcctttttg

SEQ ID NO: 1057 - DNA, 58 bp, Artificial Sequence
  Description of Artificial Sequence: Synthetic oligonucleotide
ccgggccgttcccttctccattatcctcgaggataatggagaagggaacggctttttg

SEQ ID NO: 1058 - DNA, 58 bp, Artificial Sequence
  Description of Artificial Sequence: Synthetic oligonucleotide
ccggtgataattccctcgacaaattctcgagaatttgtcgagggaattatcatttttg

SEQ ID NO: 1059 - DNA, 58 bp, Artificial Sequence
  Description of Artificial Sequence: Synthetic oligonucleotide
ccgggcagaacgtatttagccattactcgagtaatggctaaatacgttctgctttttg

SEQ ID NO: 1060 - DNA, 58 bp, Artificial Sequence
  Description of Artificial Sequence: Synthetic oligonucleotide
ccggctggtctgtctttggataatactcgagtattatccaaagacagaccagtttttg

SEQ ID NO: 1061 - DNA, 58 bp, Artificial Sequence
  Description of Artificial Sequence: Synthetic oligonucleotide
ccggatgtcacgaggcctctcatacctcgaggtatgagaggcctcgtgacattttttg

SEQ ID NO: 1062 - DNA, 58 bp, Artificial Sequence
  Description of Artificial Sequence: Synthetic oligonucleotide
ccggcccagctcatgaatgactttgctcgagcaaagtcattcatgagctgggtttttg

SEQ ID NO: 1063 - DNA, 58 bp, Artificial Sequence
  Description of Artificial Sequence: Synthetic oligonucleotide
ccggctttggcttggctgttcgattctcgagaatcgaacagccaagccaaagtttttg

SEQ ID NO: 1064 - DNA, 58 bp, Artificial Sequence
  Description of Artificial Sequence: Synthetic oligonucleotide
ccggccgggagactgagatctataactcgagttatagatctcagtctcccggtttttg

SEQ ID NO: 1065 - DNA, 58 bp, Artificial Sequence
  Description of Artificial Sequence: Synthetic oligonucleotide
ccggcaggagcacctgattcctttcctcgaggaaaggaatcaggtgctcctgtttttg

SEQ ID NO: 1066 - DNA, 58 bp, Artificial Sequence
  Description of Artificial Sequence: Synthetic oligonucleotide
ccggcgtggagatcttcggtacacactcgagtgtgtaccgaagatctccacgtttttg

SEQ ID NO: 1067 - DNA, 58 bp, Artificial Sequence
  Description of Artificial Sequence: Synthetic oligonucleotide
ccgggttggaggcctttagatattactcgagtaatatctaaaggcctccaactttttg

SEQ ID NO: 1068 - DNA, 58 bp, Artificial Sequence
  Description of Artificial Sequence: Synthetic oligonucleotide
ccggatgctcatatcaatcctataactcgagttataggattgatatgagcattttttg

SEQ ID NO: 1069 - DNA, 58 bp, Artificial Sequence
  Description of Artificial Sequence: Synthetic oligonucleotide
ccggacggttaggaagttgattattctcgagaataatcaacttcctaaccgttttttg

SEQ ID NO: 1070 - DNA, 58 bp, Artificial Sequence
  Description of Artificial Sequence: Synthetic oligonucleotide
ccggcacactgcagtcggagctaatctcgagattagctccgactgcagtgtgtttttg

SEQ ID NO: 1071 - DNA, 58 bp, Artificial Sequence
  Description of Artificial Sequence: Synthetic oligonucleotide
ccgggaagccagaaattgtagattcctcgaggaatctacaatttctggcttctttttg

SEQ ID NO: 1072 - DNA, 58 bp, Artificial Sequence
  Description of Artificial Sequence: Synthetic oligonucleotide
ccggtgctgatcctccctgagatagctcgagctatctcagggaggatcagcatttttg

SEQ ID NO: 1073 - DNA, 58 bp, Artificial Sequence
  Description of Artificial Sequence: Synthetic oligonucleotide
ccgggagttctgtgtggaagataaactcgagtttatcttccacacagaactctttttg

SEQ ID NO: 1074 - DNA, 58 bp, Artificial Sequence
  Description of Artificial Sequence: Synthetic oligonucleotide
ccgggcgcacgtatgacagtgattgctcgagcaatcactgtcatacgtgcgctttttg

SEQ ID NO: 1075 - DNA, 58 bp, Artificial Sequence
  Description of Artificial Sequence: Synthetic oligonucleotide
ccggacgacggagtcacctacgaaactcgagtttcgtaggtgactccgtcgttttttg

SEQ ID NO: 1076 - DNA, 58 bp, Artificial Sequence
  Description of Artificial Sequence: Synthetic oligonucleotide
ccggcggcatagagaccgacttaatctcgagattaagtcggtctctatgccgtttttg

SEQ ID NO: 1077 - DNA, 58 bp, Artificial Sequence
  Description of Artificial Sequence: Synthetic oligonucleotide
ccgggcggcatagagaccgacttaactcgagttaagtcggtctctatgccgctttttg

SEQ ID NO: 1078 - DNA, 58 bp, Artificial Sequence
  Description of Artificial Sequence: Synthetic oligonucleotide
ccggatccacagtcagccataataactcgagttattatggctgactgtggattttttg

SEQ ID NO: 1079 - DNA, 58 bp, Artificial Sequence
  Description of Artificial Sequence: Synthetic oligonucleotide
ccggactgcttaaagttggtattaactcgagttaataccaactttaagcagttttttg

SEQ ID NO: 1080 - DNA, 58 bp, Artificial Sequence
  Description of Artificial Sequence: Synthetic oligonucleotide
ccggcagcctgatcttcacactaatctcgagattagtgtgaagatcaggctgtttttg

SEQ ID NO: 1081 - DNA, 58 bp, Artificial Sequence
  Description of Artificial Sequence: Synthetic oligonucleotide
ccggagaagtagatgtcggagaaatctcgagatttctccgacatctacttcttttttg

SEQ ID NO: 1082 - DNA, 58 bp, Artificial Sequence
  Description of Artificial Sequence: Synthetic oligonucleotide
ccgggccagagtaaccctgactaatctcgagattagtcagggttactctggctttttg

SEQ ID NO: 1083 - DNA, 58 bp, Artificial Sequence
  Description of Artificial Sequence: Synthetic oligonucleotide
ccggcctctttccagtggatcataactcgagttatgatccactggaaagaggtttttg

SEQ ID NO: 1084 - DNA, 58 bp, Artificial Sequence
  Description of Artificial Sequence: Synthetic oligonucleotide
ccggtactcggctcaggccattatgctcgagcataatggcctgagccgagtatttttg

SEQ ID NO: 1085 - DNA, 58 bp, Artificial Sequence
  Description of Artificial Sequence: Synthetic oligonucleotide
ccggattcacggagaatgcaaatatctcgagatatttgcattctccgtgaattttttg

SEQ ID NO: 1086 - DNA, 58 bp, Artificial Sequence
  Description of Artificial Sequence: Synthetic oligonucleotide
ccggtgtgccacagcaatatctattctcgagaatagatattgctgtggcacatttttg

SEQ ID NO: 1087 - DNA, 58 bp, Artificial Sequence
  Description of Artificial Sequence: Synthetic oligonucleotide
ccggactgcgttaaaggctcgatttctcgagaaatcgagcctttaacgcagttttttg

SEQ ID NO: 1088 - DNA, 58 bp, Artificial Sequence
  Description of Artificial Sequence: Synthetic oligonucleotide
ccggccggctcaataacatcgttaactcgagttaacgatgttattgagccggtttttg

SEQ ID NO: 1089 - DNA, 58 bp, Artificial Sequence
  Description of Artificial Sequence: Synthetic oligonucleotide
ccggacaagccagccggctcaataactcgagttattgagccggctggcttgttttttg

SEQ ID NO: 1090 - DNA, 58 bp, Artificial Sequence
  Description of Artificial Sequence: Synthetic oligonucleotide
ccggactgacgaggacagctatattctcgagaatatagctgtcctcgtcagttttttg

SEQ ID NO: 1091 - DNA, 58 bp, Artificial Sequence
  Description of Artificial Sequence: Synthetic oligonucleotide
ccgggctcgtaagtcctccatcaaactcgagtttgatggaggacttacgagctttttg

SEQ ID NO: 1092 - DNA, 58 bp, Artificial Sequence
  Description of Artificial Sequence: Synthetic oligonucleotide
ccggacagctgtgcctacgactatcctcgaggatagtcgtaggcacagctgttttttg

SEQ ID NO: 1093 - DNA, 58 bp, Artificial Sequence
  Description of Artificial Sequence: Synthetic oligonucleotide
ccggagcaagacggtgtcgactttactcgagtaaagtcgacaccgtcttgcttttttg

SEQ ID NO: 1094 - DNA, 58 bp, Artificial Sequence
  Description of Artificial Sequence: Synthetic oligonucleotide
ccgggcgtcgtcacctacaagtttactcgagtaaacttgtaggtgacgacgctttttg

SEQ ID NO: 1095 - DNA, 58 bp, Artificial Sequence
  Description of Artificial Sequence: Synthetic oligonucleotide
ccggcatggctgaacttaggctatactcgagtatagcctaagttcagccatgtttttg

SEQ ID NO: 1096 - DNA, 58 bp, Artificial Sequence
  Description of Artificial Sequence: Synthetic oligonucleotide
ccggtactacgcgatggtctcaattctcgagaattgagaccatcgcgtagtatttttg

SEQ ID NO: 1097 - DNA, 58 bp, Artificial Sequence
  Description of Artificial Sequence: Synthetic oligonucleotide
ccgggccttcttgttactctatttcctcgaggaaatagagtaacaagaaggctttttg

SEQ ID NO: 1098 - DNA, 58 bp, Artificial Sequence
  Description of Artificial Sequence: Synthetic oligonucleotide
ccggatggaacacagggcccaaatgctcgagcatttgggccctgtgttccattttttg

SEQ ID NO: 1099 - DNA, 58 bp, Artificial Sequence
  Description of Artificial Sequence: Synthetic oligonucleotide
ccgggatcatctgaactccactaatctcgagattagtggagttcagatgatctttttg

SEQ ID NO: 1100 - DNA, 58 bp, Artificial Sequence
  Description of Artificial Sequence: Synthetic oligonucleotide
ccggccggagattcttctttaatttctcgagaaattaaagaagaatctccggtttttg

SEQ ID NO: 1101 - DNA, 58 bp, Artificial Sequence
  Description of Artificial Sequence: Synthetic oligonucleotide
ccggcaagatgctttaggaaacaatctcgagattgtttcctaaagcatcttgtttttg

SEQ ID NO: 1102 - DNA, 58 bp, Artificial Sequence
  Description of Artificial Sequence: Synthetic oligonucleotide
ccggcttacagggacaccggaatttctcgagaaattccggtgtccctgtaagtttttg

SEQ ID NO: 1103 - DNA, 58 bp, Artificial Sequence
  Description of Artificial Sequence: Synthetic oligonucleotide
ccggggccaaatctcatcgagatatctcgagatatctcgatgagatttggcctttttg

SEQ ID NO: 1104 - DNA, 58 bp, Artificial Sequence
  Description of Artificial Sequence: Synthetic oligonucleotide
ccgggtggattgaacctcggaattgctcgagcaattccgaggttcaatccactttttg

SEQ ID NO: 1105 - DNA, 58 bp, Artificial Sequence
  Description of Artificial Sequence: Synthetic oligonucleotide
ccggccctggtcaattctgtcaattctcgagaattgacagaattgaccagggtttttg

SEQ ID NO: 1106 - DNA, 58 bp, Artificial Sequence
  Description of Artificial Sequence: Synthetic oligonucleotide
ccggtccttgaggatagacagatatctcgagatatctgtctatcctcaaggatttttg

SEQ ID NO: 1107 - DNA, 58 bp, Artificial Sequence
  Description of Artificial Sequence: Synthetic oligonucleotide
ccggagggccagcatgtcaggattactcgagtaatcctgacatgctggcccttttttg

SEQ ID NO: 1108 - DNA, 58 bp, Artificial Sequence
  Description of Artificial Sequence: Synthetic oligonucleotide
ccggtggacgcagtatcaacgtaaactcgagtttacgttgatactgcgtccatttttg

SEQ ID NO: 1109 - DNA, 58 bp, Artificial Sequence
  Description of Artificial Sequence: Synthetic oligonucleotide
ccggccagaaggatacgctgcatttctcgagaaatgcagcgtatccttctggtttttg

SEQ ID NO: 1110 - DNA, 58 bp, Artificial Sequence
  Description of Artificial Sequence: Synthetic oligonucleotide
ccggatgccaccaaccacgctatagctcgagctatagcgtggttggtggcattttttg

SEQ ID NO: 1111 - DNA, 58 bp, Artificial Sequence
  Description of Artificial Sequence: Synthetic oligonucleotide
ccggatacaggaatatggttgtaagctcgagcttacaaccatattcctgtattttttg

SEQ ID NO: 1112 - DNA, 58 bp, Artificial Sequence
  Description of Artificial Sequence: Synthetic oligonucleotide
ccggcgccgacaacagagtcgtaatctcgagattacgactctgttgtcggcgtttttg

SEQ ID NO: 1113 - DNA, 58 bp, Artificial Sequence
  Description of Artificial Sequence: Synthetic oligonucleotide
ccggctgtctatcaaaggtagatttctcgagaaatctacctttgatagacagtttttg

SEQ ID NO: 1114 - DNA, 58 bp, Artificial Sequence
  Description of Artificial Sequence: Synthetic oligonucleotide
ccggacgttccggatcagcgtttatctcgagataaacgctgatccggaacgttttttg

SEQ ID NO: 1115 - DNA, 58 bp, Artificial Sequence
  Description of Artificial Sequence: Synthetic oligonucleotide
ccggactcgtttccagaggtaattactcgagtaattacctctggaaacgagttttttg

SEQ ID NO: 1116 - DNA, 58 bp, Artificial Sequence
  Description of Artificial Sequence: Synthetic oligonucleotide
ccggaccatcgagagttccggtttgctcgagcaaaccggaactctcgatggttttttg

SEQ ID NO: 1117 - DNA, 58 bp, Artificial Sequence
  Description of Artificial Sequence: Synthetic oligonucleotide
ccggagggtgcagttagcatattagctcgagctaatatgctaactgcacccttttttg

SEQ ID NO: 1118 - DNA, 58 bp, Artificial Sequence
  Description of Artificial Sequence: Synthetic oligonucleotide
ccggagcacagaagtcctatcttagctcgagctaagataggacttctgtgcttttttg

SEQ ID NO: 1119 - DNA, 58 bp, Artificial Sequence
  Description of Artificial Sequence: Synthetic oligonucleotide
ccggaggtacaacactggccatttcctcgaggaaatggccagtgttgtaccttttttg

SEQ ID NO: 1120 - DNA, 58 bp, Artificial Sequence
  Description of Artificial Sequence: Synthetic oligonucleotide
ccggccaaggctactcggcctattactcgagtaataggccgagtagccttggtttttg

SEQ ID NO: 1121 - DNA, 58 bp, Artificial Sequence
  Description of Artificial Sequence: Synthetic oligonucleotide
ccgggaccctcacaaccacgtacatctcgagatgtacgtggttgtgagggtctttttg

SEQ ID NO: 1122 - DNA, 58 bp, Artificial Sequence
  Description of Artificial Sequence: Synthetic oligonucleotide
ccggcgttaacatggtggagcgagactcgagtctcgctccaccatgttaacgtttttg

SEQ ID NO: 1123 - DNA, 58 bp, Artificial Sequence
  Description of Artificial Sequence: Synthetic oligonucleotide
ccgggaacggctatgtgcgtttaaactcgagtttaaacgcacatagccgttctttttg

SEQ ID NO: 1124 - DNA, 58 bp, Artificial Sequence
  Description of Artificial Sequence: Synthetic oligonucleotide
ccgggcctatggagtgaaattatttctcgagaaataatttcactccataggctttttg

SEQ ID NO: 1125 - DNA, 58 bp, Artificial Sequence
  Description of Artificial Sequence: Synthetic oligonucleotide
ccggattaccacgaggagatcattactcgagtaatgatctcctcgtggtaattttttg

SEQ ID NO: 1126 - DNA, 58 bp, Artificial Sequence
  Description of Artificial Sequence: Synthetic oligonucleotide
ccggcatcatgtgaggctctgtaaactcgagtttacagagcctcacatgatgtttttg

SEQ ID NO: 1127 - DNA, 58 bp, Artificial Sequence
  Description of Artificial Sequence: Synthetic oligonucleotide
ccggcccaactcaacaaacctgaaactcgagtttcaggtttgttgagttgggtttttg

SEQ ID NO: 1128 - DNA, 58 bp, Artificial Sequence
  Description of Artificial Sequence: Synthetic oligonucleotide
ccgggccatcaactttcagagctatctcgagatagctctgaaagttgatggctttttg

SEQ ID NO: 1129 - DNA, 58 bp, Artificial Sequence
  Description of Artificial Sequence: Synthetic oligonucleotide
ccggacaccgagttcgtcaacattgctcgagcaatgttgacgaactcggtgttttttg

SEQ ID NO: 1130 - DNA, 58 bp, Artificial Sequence
  Description of Artificial Sequence: Synthetic oligonucleotide
ccgggcgtaagacgctgtcggttaactcgagttaaccgacagcgtcttacgctttttg

SEQ ID NO: 1131 - DNA, 58 bp, Artificial Sequence
  Description of Artificial Sequence: Synthetic oligonucleotide
ccggcgaggtgcaggccatgatttactcgagtaaatcatggcctgcacctcgtttttg

SEQ ID NO: 1132 - DNA, 58 bp, Artificial Sequence
  Description of Artificial Sequence: Synthetic oligonucleotide
ccggacgatggagcctgcgttaatactcgagtattaacgcaggctccatcgttttttg

SEQ ID NO: 1133 - DNA, 58 bp, Artificial Sequence
  Description of Artificial Sequence: Synthetic oligonucleotide
ccggtcccgacttctggtctattacctcgaggtaatagaccagaagtcgggatttttg

SEQ ID NO: 1134 - DNA, 58 bp, Artificial Sequence
  Description of Artificial Sequence: Synthetic oligonucleotide
ccgggcccgagagaacagcttatatctcgagatataagctgttctctcgggctttttg

SEQ ID NO: 1135 - DNA, 58 bp, Artificial Sequence
  Description of Artificial Sequence: Synthetic oligonucleotide
ccgggcaatcctgtgttacagaaatctcgagatttctgtaacacaggattgctttttg

SEQ ID NO: 1136 - DNA, 58 bp, Artificial Sequence
  Description of Artificial Sequence: Synthetic oligonucleotide
ccggctgctccaatgagggcttaatctcgagattaagccctcattggagcagtttttg

SEQ ID NO: 1137 - DNA, 58 bp, Artificial Sequence
  Description of Artificial Sequence: Synthetic oligonucleotide
ccggcctgagggcaatcctgtgttactcgagtaacacaggattgccctcaggtttttg

SEQ ID NO: 1138 - DNA, 58 bp, Artificial Sequence
  Description of Artificial Sequence: Synthetic oligonucleotide
ccggccaactccaaagccataaatactcgagtatttatggctttggagttggtttttg

SEQ ID NO: 1139 - DNA, 58 bp, Artificial Sequence
  Description of Artificial Sequence: Synthetic oligonucleotide
ccggcattctgaggtaacctcattactcgagtaatgaggttacctcagaatgtttttg

SEQ ID NO: 1140 - DNA, 58 bp, Artificial Sequence
  Description of Artificial Sequence: Synthetic oligonucleotide
ccggtcctccatgaatatcagttatctcgagataactgatattcatggaggatttttg

SEQ ID NO: 1141 - DNA, 58 bp, Artificial Sequence
  Description of Artificial Sequence: Synthetic oligonucleotide
ccggtggaatacttctaccataattctcgagaattatggtagaagtattccatttttg

SEQ ID NO: 1142 - DNA, 58 bp, Artificial Sequence
  Description of Artificial Sequence: Synthetic oligonucleotide
ccggtcaagctggagtacgtgaaatctcgagatttcacgtactccagcttgatttttg

SEQ ID NO: 1143 - DNA, 58 bp, Artificial Sequence
  Description of Artificial Sequence: Synthetic oligonucleotide
ccggactcaacgtcccatctacttgctcgagcaagtagatgggacgttgagttttttg

SEQ ID NO: 1144 - DNA, 58 bp, Artificial Sequence
  Description of Artificial Sequence: Synthetic oligonucleotide
ccggcctagggaccaagactgaatcctcgaggattcagtcttggtccctaggtttttg

SEQ ID NO: 1145 - DNA, 58 bp, Artificial Sequence
  Description of Artificial Sequence: Synthetic oligonucleotide
ccggcagcggattatggattactatctcgagatagtaatccataatccgctgtttttg

SEQ ID NO: 1146 - DNA, 58 bp, Artificial Sequence
  Description of Artificial Sequence: Synthetic oligonucleotide
ccggcaagcccggaattgtcttcatctcgagatgaagacaattccgggcttgtttttg

SEQ ID NO: 1147 - DNA, 58 bp, Artificial Sequence
  Description of Artificial Sequence: Synthetic oligonucleotide
ccgggctgaagccctactcaatatactcgagtatattgagtagggcttcagctttttg

SEQ ID NO: 1148 - DNA, 58 bp, Artificial Sequence
  Description of Artificial Sequence: Synthetic oligonucleotide
ccggacagagttaatgatgtcaaagctcgagctttgacatcattaactctgttttttg

SEQ ID NO: 1149 - DNA, 58 bp, Artificial Sequence
  Description of Artificial Sequence: Synthetic oligonucleotide
ccggatcccgtgttcactcatgaaactcgagtttcatgagtgaacacgggattttttg

SEQ ID NO: 1150 - DNA, 58 bp, Artificial Sequence
  Description of Artificial Sequence: Synthetic oligonucleotide
ccggaggagaagtatttcgaatattctcgagaatattcgaaatacttctccttttttg

SEQ ID NO: 1151 - DNA, 58 bp, Artificial Sequence
  Description of Artificial Sequence: Synthetic oligonucleotide
ccggaggaacttgtccacggttaaactcgagtttaaccgtggacaagttccttttttg

SEQ ID NO: 1152 - DNA, 58 bp, Artificial Sequence
  Description of Artificial Sequence: Synthetic oligonucleotide
ccggctgcctgaagtattatgagaactcgagttctcataatacttcaggcagtttttg

SEQ ID NO: 1153 - DNA, 58 bp, Artificial Sequence
  Description of Artificial Sequence: Synthetic oligonucleotide
ccgggagagtgaagaatgcagttaactcgagttaactgcattcttcactctctttttg

SEQ ID NO: 1154 - DNA, 58 bp, Artificial Sequence
  Description of Artificial Sequence: Synthetic oligonucleotide
ccgggagtacttcaagggagccattctcgagaatggctcccttgaagtactctttttg

SEQ ID NO: 1155 - DNA, 58 bp, Artificial Sequence
  Description of Artificial Sequence: Synthetic oligonucleotide
ccgggcaaagccttgagaggtcttgctcgagcaagacctctcaaggctttgctttttg

SEQ ID NO: 1156 - DNA, 58 bp, Artificial Sequence
  Description of Artificial Sequence: Synthetic oligonucleotide
ccggtctattgttgagctgcattatctcgagataatgcagctcaacaatagatttttg

SEQ ID NO: 1157 - DNA, 58 bp, Artificial Sequence
  Description of Artificial Sequence: Synthetic oligonucleotide
ccggccttcaactcttcgtacattcctcgaggaatgtacgaagagttgaaggtttttg

SEQ ID NO: 1158 - DNA, 58 bp, Artificial Sequence
  Description of Artificial Sequence: Synthetic oligonucleotide
ccgggtctatacctcctggcagattctcgagaatctgccaggaggtatagactttttg

SEQ ID NO: 1159 - DNA, 58 bp, Artificial Sequence
  Description of Artificial Sequence: Synthetic oligonucleotide
ccgggagtcaagcattgtgaattatctcgagataattcacaatgcttgactctttttg

SEQ ID NO: 1160 - DNA, 58 bp, Artificial Sequence
  Description of Artificial Sequence: Synthetic oligonucleotide
ccgggccgcagcagttaacctatgactcgagtcataggttaactgctgcggctttttg

SEQ ID NO: 1161 - DNA, 58 bp, Artificial Sequence
  Description of Artificial Sequence: Synthetic oligonucleotide
ccggccaactctgagtggcaccaatctcgagattggtgccactcagagttggtttttg

SEQ ID NO: 1162 - DNA, 58 bp, Artificial Sequence
  Description of Artificial Sequence: Synthetic oligonucleotide
ccggcccagtcacctgctgttataactcgagttataacagcaggtgactgggtttttg

SEQ ID NO: 1163 - DNA, 58 bp, Artificial Sequence; identical to SEQ ID NO: 1162
  Description of Artificial Sequence: Synthetic oligonucleotide

SEQ ID NO: 1164 - DNA, 58 bp, Artificial Sequence
  Description of Artificial Sequence: Synthetic oligonucleotide
ccgggctcgcgagctatagaagaatctcgagattcttctatagctcgcgagctttttg

SEQ ID NO: 1165 - DNA, 58 bp, Artificial Sequence
  Description of Artificial Sequence: Synthetic oligonucleotide
ccggagttgtctgtgtgcgcaaatcctcgaggatttgcgcacacagacaacttttttg

SEQ ID NO: 1166 - DNA, 58 bp, Artificial Sequence
  Description of Artificial Sequence: Synthetic oligonucleotide
ccgggaccgtattcttcatcctaaactcgagtttaggatgaagaatacggtctttttg

SEQ ID NO: 1167 - DNA, 58 bp, Artificial Sequence
  Description of Artificial Sequence: Synthetic oligonucleotide
ccggagggtttagtgcttatctaatctcgagattagataagcactaaacccttttttg

SEQ ID NO: 1168 - DNA, 58 bp, Artificial Sequence
  Description of Artificial Sequence: Synthetic oligonucleotide
ccggcactctttctcctgctttaacctcgaggttaaagcaggagaaagagtgtttttg

SEQ ID NO: 1169 - DNA, 58 bp, Artificial Sequence
  Description of Artificial Sequence: Synthetic oligonucleotide
ccgggagctatgtgcagacccaaagctcgagctttgggtctgcacatagctctttttg

SEQ ID NO: 1170 - DNA, 58 bp, Artificial Sequence
  Description of Artificial Sequence: Synthetic oligonucleotide
ccggccatcccagctatcctgttctctcgagagaacaggatagctgggatggtttttg

SEQ ID NO: 1171 - DNA, 58 bp, Artificial Sequence
  Description of Artificial Sequence: Synthetic oligonucleotide
ccggccctacctccctgccattatactcgagtataatggcagggaggtagggtttttg

SEQ ID NO: 1172 - DNA, 58 bp, Artificial Sequence
  Description of Artificial Sequence: Synthetic oligonucleotide
ccgggcgtggtgaaacacttctactctcgagagtagaagtgtttcaccacgctttttg

SEQ ID NO: 1173 - DNA, 58 bp, Artificial Sequence
  Description of Artificial Sequence: Synthetic oligonucleotide
ccggatgttgctgacacccagaaagctcgagctttctgggtgtcagcaacattttttg

SEQ ID NO: 1174 - DNA, 58 bp, Artificial Sequence
  Description of Artificial Sequence: Synthetic oligonucleotide
ccggcactcctggagagttactttgctcgagcaaagtaactctccaggagtgtttttg

SEQ ID NO: 1175 - DNA, 58 bp, Artificial Sequence
  Description of Artificial Sequence: Synthetic oligonucleotide
ccggcctttctcatgctgcaggattctcgagaatcctgcagcatgagaaaggtttttg

SEQ ID NO: 1176 - DNA, 58 bp, Artificial Sequence
  Description of Artificial Sequence: Synthetic oligonucleotide
ccgggaagctggacacacggatcaactcgagttgatccgtgtgtccagcttctttttg

SEQ ID NO: 1177 - DNA, 58 bp, Artificial Sequence
  Description of Artificial Sequence: Synthetic oligonucleotide
ccggagtgatcttcaccaccaagaactcgagttcttggtggtgaagatcacttttttg

SEQ ID NO: 1178 - DNA, 58 bp, Artificial Sequence
  Description of Artificial Sequence: Synthetic oligonucleotide
ccgggttctttgtttccaagagaatctcgagattctcttggaaacaaagaactttttg

SEQ ID NO: 1179 - DNA, 58 bp, Artificial Sequence
  Description of Artificial Sequence: Synthetic oligonucleotide
ccggcctgctgcatgttctttgtttctcgagaaacaaagaacatgcagcaggtttttg

SEQ ID NO: 1180 - DNA, 58 bp, Artificial Sequence
  Description of Artificial Sequence: Synthetic oligonucleotide
ccgggccggatctttctccgataaactcgagtttatcggagaaagatccggctttttg

SEQ ID NO: 1181 - DNA, 58 bp, Artificial Sequence
  Description of Artificial Sequence: Synthetic oligonucleotide
ccgggctcctggatgctcgaaataactcgagttatttcgagcatccaggagctttttg

SEQ ID NO: 1182 - DNA, 58 bp, Artificial Sequence
  Description of Artificial Sequence: Synthetic oligonucleotide
ccggccctcctgatatcagctaattctcgagaattagctgatatcaggagggtttttg

SEQ ID NO: 1183 - DNA, 58 bp, Artificial Sequence
  Description of Artificial Sequence: Synthetic oligonucleotide
ccggcacacgtgggagtgacatatcctcgaggatatgtcactcccacgtgtgtttttg

SEQ ID NO: 1184 - DNA, 58 bp, Artificial Sequence
  Description of Artificial Sequence: Synthetic oligonucleotide
ccggtccgaaacaattgtgactcagctcgagctgagtcacaattgtttcggatttttg

SEQ ID NO: 1185 - DNA, 58 bp, Artificial Sequence
  Description of Artificial Sequence: Synthetic oligonucleotide
ccgggctgtgatattcactaccaaactcgagtttggtagtgaatatcacagctttttg

SEQ ID NO: 1186 - DNA, 58 bp, Artificial Sequence
  Description of Artificial Sequence: Synthetic oligonucleotide
ccggttcgtgcttcacctggctcaactcgagttgagccaggtgaagcacgaatttttg

SEQ ID NO: 1187 - DNA, 58 bp, Artificial Sequence
  Description of Artificial Sequence: Synthetic oligonucleotide
ccggccgaaagccactctcagacaactcgagttgtctgagagtggctttcggtttttg

SEQ ID NO: 1188 - DNA, 58 bp, Artificial Sequence
  Description of Artificial Sequence: Synthetic oligonucleotide
ccggcaagctactgaggaaggtcatctcgagatgaccttcctcagtagcttgtttttg

SEQ ID NO: 1189 - DNA, 58 bp, Artificial Sequence
  Description of Artificial Sequence: Synthetic oligonucleotide
ccggcggaggtttcacatcatatttctcgagaaatatgatgtgaaacctccgtttttg

SEQ ID NO: 1190 - DNA, 58 bp, Artificial Sequence
  Description of Artificial Sequence: Synthetic oligonucleotide
ccggcacgaaacatacggccataaactcgagtttatggccgtatgtttcgtgtttttg

SEQ ID NO: 1191 - DNA, 58 bp, Artificial Sequence
  Description of Artificial Sequence: Synthetic oligonucleotide
ccggttagagagtctacagataaatctcgagatttatctgtagactctctaatttttg

SEQ ID NO: 1192 - DNA, 58 bp, Artificial Sequence
  Description of Artificial Sequence: Synthetic oligonucleotide
ccggccggcagattccacagaatttctcgagaaattctgtggaatctgccggtttttg

SEQ ID NO: 1193 - DNA, 58 bp, Artificial Sequence
  Description of Artificial Sequence: Synthetic oligonucleotide
ccggttcgatttcacagtgtgtttgctcgagcaaacacactgtgaaatcgaatttttg

SEQ ID NO: 1194 - DNA, 58 bp, Artificial Sequence
  Description of Artificial Sequence: Synthetic oligonucleotide
ccggcaaccagttctctgcatcactctcgagagtgatgcagagaactggttgtttttg

SEQ ID NO: 1195 - DNA, 58 bp, Artificial Sequence
  Description of Artificial Sequence: Synthetic oligonucleotide
ccggatgtgccgtgttattgtattactcgagtaatacaataacacggcacattttttg

SEQ ID NO: 1196 - DNA, 58 bp, Artificial Sequence
  Description of Artificial Sequence: Synthetic oligonucleotide
ccggtcctgtcccttctcttaatttctcgagaaattaagagaagggacaggatttttg

SEQ ID NO: 1197 - DNA, 58 bp, Artificial Sequence
  Description of Artificial Sequence: Synthetic oligonucleotide
ccggctgtgctgatcccagtgaatcctcgaggattcactgggatcagcacagtttttg

SEQ ID NO: 1198 - DNA, 58 bp, Artificial Sequence
  Description of Artificial Sequence: Synthetic oligonucleotide
ccggtgaacctgaacttacacaaatctcgagatttgtgtaagttcaggttcatttttg

SEQ ID NO: 1199 - DNA, 58 bp, Artificial Sequence
  Description of Artificial Sequence: Synthetic oligonucleotide
ccggcctgctgctttgcctacattgctcgagcaatgtaggcaaagcagcaggtttttg

SEQ ID NO: 1200 - DNA, 58 bp, Artificial Sequence
  Description of Artificial Sequence: Synthetic oligonucleotide
ccggctaccacacagcagcagttacctcgaggtaactgctgctgtgtggtagtttttg

SEQ ID NO: 1201 - DNA, 58 bp, Artificial Sequence
  Description of Artificial Sequence: Synthetic oligonucleotide
ccggcataaagccttggatgtatatctcgagatatacatccaaggctttatgtttttg

SEQ ID NO: 1202 - DNA, 58 bp, Artificial Sequence
  Description of Artificial Sequence: Synthetic oligonucleotide
ccgggctgctacagatttatcaatactcgagtattgataaatctgtagcagctttttg

SEQ ID NO: 1203 - DNA, 58 bp, Artificial Sequence
  Description of Artificial Sequence: Synthetic oligonucleotide
ccggtctaaggaatatgagctttatctcgagataaagctcatattccttagatttttg

SEQ ID NO: 1204 - DNA, 58 bp, Artificial Sequence
  Description of Artificial Sequence: Synthetic oligonucleotide
ccgggctgctttaacgtgatcaatactcgagtattgatcacgttaaagcagctttttg

SEQ ID NO: 1205 - DNA, 58 bp, Artificial Sequence
  Description of Artificial Sequence: Synthetic oligonucleotide
ccggcaggtgcagtgtgacattattctcgagaataatgtcacactgcacctgtttttg

SEQ ID NO: 1206 - DNA, 58 bp, Artificial Sequence
  Description of Artificial Sequence: Synthetic oligonucleotide
ccggttgtactgctgttgttgaaatctcgagatttcaacaacagcagtacaatttttg

SEQ ID NO: 1207 - DNA, 58 bp, Artificial Sequence
  Description of Artificial Sequence: Synthetic oligonucleotide
ccggattctgctaagacgaccaaatctcgagatttggtcgtcttagcagaattttttg

SEQ ID NO: 1208 - DNA, 58 bp, Artificial Sequence
  Description of Artificial Sequence: Synthetic oligonucleotide
ccggatctgctacacagggattatactcgagtataatccctgtgtagcagattttttg

SEQ ID NO: 1209 - DNA, 58 bp, Artificial Sequence
  Description of Artificial Sequence: Synthetic oligonucleotide
ccggcctctgtactccttggtatttctcgagaaataccaaggagtacagaggtttttg

SEQ ID NO: 1210 - DNA, 58 bp, Artificial Sequence
  Description of Artificial Sequence: Synthetic oligonucleotide
ccggacggtgctccctgtcataaatctcgagatttatgacagggagcaccgttttttg

SEQ ID NO: 1211 - DNA, 58 bp, Artificial Sequence
  Description of Artificial Sequence: Synthetic oligonucleotide
ccggcttctggactccctataatatctcgagatattatagggagtccagaagtttttg

SEQ ID NO: 1212 - DNA, 58 bp, Artificial Sequence
  Description of Artificial Sequence: Synthetic oligonucleotide
ccgggctgtatcacatcggttatttctcgagaaataaccgatgtgatacagctttttg

SEQ ID NO: 1213 - DNA, 58 bp, Artificial Sequence
  Description of Artificial Sequence: Synthetic oligonucleotide
ccggatacaggaggctccgaattatctcgagataattcggagcctcctgtattttttg

SEQ ID NO: 1214 - DNA, 58 bp, Artificial Sequence
  Description of Artificial Sequence: Synthetic oligonucleotide
ccggcccagaggatacagtatatagctcgagctatatactgtatcctctgggtttttg

SEQ ID NO: 1215 - DNA, 58 bp, Artificial Sequence
  Description of Artificial Sequence: Synthetic oligonucleotide
ccggtagcagctcttcctgaatttactcgagtaaattcaggaagagctgctatttttg

SEQ ID NO: 1216 - DNA, 58 bp, Artificial Sequence
  Description of Artificial Sequence: Synthetic oligonucleotide
ccggactcttgacagggctctatttctcgagaaatagagccctgtcaagagttttttg

SEQ ID NO: 1217 - DNA, 58 bp, Artificial Sequence
  Description of Artificial Sequence: Synthetic oligonucleotide
ccggcgagcgagcaagctcagtttactcgagtaaactgagcttgctcgctcgtttttg

SEQ ID NO: 1218 - DNA, 58 bp, Artificial Sequence
  Description of Artificial Sequence: Synthetic oligonucleotide
ccggtccatacagtcagtatcaattctcgagaattgatactgactgtatggatttttg

SEQ ID NO: 1219 - DNA, 58 bp, Artificial Sequence
  Description of Artificial Sequence: Synthetic oligonucleotide
ccggggtctatgacagacgtctatcctcgaggatagacgtctgtcatagacctttttg

SEQ ID NO: 1220 - DNA, 58 bp, Artificial Sequence
  Description of Artificial Sequence: Synthetic oligonucleotide
ccggcgactccagtgaagattatttctcgagaaataatcttcactggagtcgtttttg

SEQ ID NO: 1221 - DNA, 58 bp, Artificial Sequence
  Description of Artificial Sequence: Synthetic oligonucleotide
ccggtcgactccagtgaagattattctcgagaataatcttcactggagtcgatttttg

SEQ ID NO: 1222 - DNA, 58 bp, Artificial Sequence
  Description of Artificial Sequence: Synthetic oligonucleotide
ccgggatgaggtcacggacgattacctcgaggtaatcgtccgtgacctcatctttttg

SEQ ID NO: 1223 - DNA, 58 bp, Artificial Sequence
  Description of Artificial Sequence: Synthetic oligonucleotide
ccgggctggtcgtgttgacctatatctcgagatataggtcaacacgaccagctttttg

SEQ ID NO: 1224 - DNA, 58 bp, Artificial Sequence
  Description of Artificial Sequence: Synthetic oligonucleotide
ccggcgtgttgacctatatctatttctcgagaaatagatataggtcaacacgtttttg

SEQ ID NO: 1225 - DNA, 58 bp, Artificial Sequence
  Description of Artificial Sequence: Synthetic oligonucleotide
ccgggccgatccttacatagatattctcgagaatatctatgtaaggatcggctttttg

SEQ ID NO: 1226 - DNA, 58 bp, Artificial Sequence
  Description of Artificial Sequence: Synthetic oligonucleotide
ccggcccggaggaaatgtgactattctcgagaatagtcacatttcctccgggtttttg

SEQ ID NO: 1227 - DNA, 58 bp, Artificial Sequence
  Description of Artificial Sequence: Synthetic oligonucleotide
ccggccgcttatcatttgagaccaactcgagttggtctcaaatgataagcggtttttg

SEQ ID NO: 1228 - DNA, 58 bp, Artificial Sequence
  Description of Artificial Sequence: Synthetic oligonucleotide
ccggcttaccttatgtcagtgagatctcgagatctcactgacataaggtaagtttttg

SEQ ID NO: 1229 - DNA, 58 bp, Artificial Sequence
  Description of Artificial Sequence: Synthetic oligonucleotide
ccgggcactgtaactctggtcttctctcgagagaagaccagagttacagtgctttttg

SEQ ID NO: 1230 - DNA, 58 bp, Artificial Sequence
  Description of Artificial Sequence: Synthetic oligonucleotide
ccggccacccacttaccttatgtcactcgagtgacataaggtaagtgggtggtttttg

SEQ ID NO: 1231 - DNA, 58 bp, Artificial Sequence
  Description of Artificial Sequence: Synthetic oligonucleotide
ccgggccagatgtgtgagccaggaactcgagttcctggctcacacatctggctttttg

SEQ ID NO: 1232 - DNA, 58 bp, Artificial Sequence
  Description of Artificial Sequence: Synthetic oligonucleotide
ccggcctccagaatttgtatgttaactcgagttaacatacaaattctggaggtttttg

SEQ ID NO: 1233 - DNA, 58 bp, Artificial Sequence
  Description of Artificial Sequence: Synthetic oligonucleotide
ccggcaaccttagctgcaagtattcctcgaggaatacttgcagctaaggttgtttttg

SEQ ID NO: 1234 - DNA, 58 bp, Artificial Sequence
  Description of Artificial Sequence: Synthetic oligonucleotide
ccggtggagtcctggcttgctatagctcgagctatagcaagccaggactccatttttg

SEQ ID NO: 1235 - DNA, 58 bp, Artificial Sequence
  Description of Artificial Sequence: Synthetic oligonucleotide
ccggcctcctccttacctagacaatctcgagattgtctaggtaaggaggaggtttttg

SEQ ID NO: 1236 - DNA, 58 bp, Artificial Sequence
  Description of Artificial Sequence: Synthetic oligonucleotide
ccggagaacctattgatggattaaactcgagtttaatccatcaataggttcttttttg

SEQ ID NO: 1237 - DNA, 58 bp, Artificial Sequence
  Description of Artificial Sequence: Synthetic oligonucleotide
ccgggccataatcgacacatataaactcgagtttatatgtgtcgattatggctttttg

SEQ ID NO: 1238 - DNA, 58 bp, Artificial Sequence
  Description of Artificial Sequence: Synthetic oligonucleotide
ccggacggctgcaggtcaacctattctcgagaataggttgacctgcagccgttttttg

SEQ ID NO: 1239 - DNA, 58 bp, Artificial Sequence
  Description of Artificial Sequence: Synthetic oligonucleotide
ccggcctgatcatcaagaatcttaactcgagttaagattcttgatgatcaggtttttg

SEQ ID NO: 1240 - DNA, 58 bp, Artificial Sequence
  Description of Artificial Sequence: Synthetic oligonucleotide
ccggagagcggatgtctcagatcaactcgagttgatctgagacatccgctcttttttg

SEQ ID NO: 1241 - DNA, 58 bp, Artificial Sequence
  Description of Artificial Sequence: Synthetic oligonucleotide
ccggccactcgcctttacagttgaactcgagttcaactgtaaaggcgagtggtttttg

SEQ ID NO: 1242 - DNA, 58 bp, Artificial Sequence
  Description of Artificial Sequence: Synthetic oligonucleotide
ccgggggaaacagctgaccgttaaactcgagtttaacggtcagctgtttccctttttg

SEQ ID NO: 1243 - DNA, 58 bp, Artificial Sequence
  Description of Artificial Sequence: Synthetic oligonucleotide
ccggttcgagtcaagctccatttatctcgagataaatggagcttgactcgaatttttg

SEQ ID NO: 1244 - DNA, 58 bp, Artificial Sequence
  Description of Artificial Sequence: Synthetic oligonucleotide
ccggtgacgctgggagtcttcataactcgagttatgaagactcccagcgtcatttttg

SEQ ID NO: 1245 - DNA, 58 bp, Artificial Sequence
  Description of Artificial Sequence: Synthetic oligonucleotide
ccggccatcgtgatggcatctacatctcgagatgtagatgccatcacgatggtttttg

SEQ ID NO: 1246 - DNA, 58 bp, Artificial Sequence
  Description of Artificial Sequence: Synthetic oligonucleotide
ccggcagctacgtatccatcgtgatctcgagatcacgatggatacgtagctgtttttg

SEQ ID NO: 1247 - DNA, 58 bp, Artificial Sequence
  Description of Artificial Sequence: Synthetic oligonucleotide
ccggccaacctcactgggacactttctcgagaaagtgtcccagtgaggttggtttttg

SEQ ID NO: 1248 - DNA, 58 bp, Artificial Sequence
  Description of Artificial Sequence: Synthetic oligonucleotide
ccggcaagtcggaacagcagataacctcgaggttatctgctgttccgacttgtttttg

SEQ ID NO: 1249 - DNA, 58 bp, Artificial Sequence
  Description of Artificial Sequence: Synthetic oligonucleotide
ccgggagaacctgagacaccttaagctcgagcttaaggtgtctcaggttctctttttg

SEQ ID NO: 1250 - DNA, 58 bp, Artificial Sequence
  Description of Artificial Sequence: Synthetic oligonucleotide
ccggccacacagctacagctttcttctcgagaagaaagctgtagctgtgtggtttttg

SEQ ID NO: 1251 - DNA, 58 bp, Artificial Sequence
  Description of Artificial Sequence: Synthetic oligonucleotide
ccgggctggacttcgcctgtgatatctcgagatatcacaggcgaagtccagctttttg

SEQ ID NO: 1252 - DNA, 58 bp, Artificial Sequence
  Description of Artificial Sequence: Synthetic oligonucleotide
ccgggtgtattcattctcatgattactcgagtaatcatgagaatgaatacactttttg

SEQ ID NO: 1253 - DNA, 58 bp, Artificial Sequence
  Description of Artificial Sequence: Synthetic oligonucleotide
ccggccagagacagcttgatcaaagctcgagctttgatcaagctgtctctggtttttg

SEQ ID NO: 1254 - DNA, 58 bp, Artificial Sequence
  Description of Artificial Sequence: Synthetic oligonucleotide
ccggccttctcctgtcactggttatctcgagataaccagtgacaggagaaggtttttg

SEQ ID NO: 1255 - DNA, 58 bp, Artificial Sequence
  Description of Artificial Sequence: Synthetic oligonucleotide
ccgggagaagatgctgtccagatttctcgagaaatctggacagcatcttctctttttg

SEQ ID NO: 1256 - DNA, 58 bp, Artificial Sequence
  Description of Artificial Sequence: Synthetic oligonucleotide
ccggccagccgatagatggaatgaactcgagttcattccatctatcggctggtttttg

SEQ ID NO: 1257 - DNA, 58 bp, Artificial Sequence
  Description of Artificial Sequence: Synthetic oligonucleotide
ccggcaagaaattctggcaccacttctcgagaagtggtgccagaatttcttgtttttg

SEQ ID NO: 1258 - DNA, 58 bp, Artificial Sequence
  Description of Artificial Sequence: Synthetic oligonucleotide
ccggacgtcctgcaaagtgtcctttctcgagaaaggacactttgcaggacgttttttg

SEQ ID NO: 1259 - DNA, 58 bp, Artificial Sequence
  Description of Artificial Sequence: Synthetic oligonucleotide
ccggactgatccagagctggagaaactcgagtttctccagctctggatcagttttttg

SEQ ID NO: 1260 - DNA, 58 bp, Artificial Sequence
  Description of Artificial Sequence: Synthetic oligonucleotide
ccggcggctgctgaagggattctatctcgagatagaatcccttcagcagccgtttttg

SEQ ID NO: 1261 - DNA, 58 bp, Artificial Sequence
  Description of Artificial Sequence: Synthetic oligonucleotide
ccggcctttgcttgtgtttgcacttctcgagaagtgcaaacacaagcaaaggtttttg

SEQ ID NO: 1262 - DNA, 58 bp, Artificial Sequence
  Description of Artificial Sequence: Synthetic oligonucleotide
ccggccctgaaccatatattgttatctcgagataacaatatatggttcagggtttttg

SEQ ID NO: 1263 - DNA, 58 bp, Artificial Sequence
  Description of Artificial Sequence: Synthetic oligonucleotide
ccggtggatttgaagtcaccgttatctcgagataacggtgacttcaaatccatttttg

SEQ ID NO: 1264 - DNA, 58 bp, Artificial Sequence
  Description of Artificial Sequence: Synthetic oligonucleotide
ccgggaaacaaacatggtggcaattctcgagaattgccaccatgtttgtttctttttg

SEQ ID NO: 1265 - DNA, 58 bp, Artificial Sequence
  Description of Artificial Sequence: Synthetic oligonucleotide
ccggccacaggatttcctgaaagttctcgagaactttcaggaaatcctgtggtttttg

SEQ ID NO: 1266 - DNA, 58 bp, Artificial Sequence
  Description of Artificial Sequence: Synthetic oligonucleotide
ccggcatggtggcaattctacacaactcgagttgtgtagaattgccaccatgtttttg

SEQ ID NO: 1267 - DNA, 58 bp, Artificial Sequence
  Description of Artificial Sequence: Synthetic oligonucleotide
ccggcaccacttgctgacctatttactcgagtaaataggtcagcaagtggtgtttttg

SEQ ID NO: 1268 - DNA, 58 bp, Artificial Sequence
  Description of Artificial Sequence: Synthetic oligonucleotide
ccgggacctatttacattggcccttctcgagaagggccaatgtaaataggtctttttg

SEQ ID NO: 1269 - DNA, 58 bp, Artificial Sequence
  Description of Artificial Sequence: Synthetic oligonucleotide
ccgggctgtgttcctttcagtagttctcgagaactactgaaaggaacacagctttttg

SEQ ID NO: 1270 - DNA, 58 bp, Artificial Sequence
  Description of Artificial Sequence: Synthetic oligonucleotide
ccgggtaaggagccatcggacaaacctcgaggtttgtccgatggctccttactttttg

SEQ ID NO: 1271 - DNA, 58 bp, Artificial Sequence
  Description of Artificial Sequence: Synthetic oligonucleotide
ccggcttacttgctgtgatccttatctcgagataaggatcacagcaagtaagtttttg

SEQ ID NO: 1272 - DNA, 58 bp, Artificial Sequence
  Description of Artificial Sequence: Synthetic oligonucleotide
ccggcataaggagccatcggacaaactcgagtttgtccgatggctccttatgtttttg

SEQ ID NO: 1273 - DNA, 58 bp, Artificial Sequence
  Description of Artificial Sequence: Synthetic oligonucleotide
ccggcatcgtgtttgcaactgatttctcgagaaatcagttgcaaacacgatgtttttg

SEQ ID NO: 1274 - DNA, 58 bp, Artificial Sequence
  Description of Artificial Sequence: Synthetic oligonucleotide
ccgggcttcttaacagatggcatttctcgagaaatgccatctgttaagaagctttttg

SEQ ID NO: 1275 - DNA, 58 bp, Artificial Sequence; identical to SEQ ID NO: 1274
  Description of Artificial Sequence: Synthetic oligonucleotide

SEQ ID NO: 1276 - DNA, 58 bp, Artificial Sequence
  Description of Artificial Sequence: Synthetic oligonucleotide
ccggcaactggaatctgacagatttctcgagaaatctgtcagattccagttgtttttg

SEQ ID NO: 1277 - DNA, 58 bp, Artificial Sequence
  Description of Artificial Sequence: Synthetic oligonucleotide
ccgggactggcgtcttgctgattatctcgagataatcagcaagacgccagtctttttg

SEQ ID NO: 1278 - DNA, 58 bp, Artificial Sequence
  Description of Artificial Sequence: Synthetic oligonucleotide
ccgggcagaaattgctgccgtgatactcgagtatcacggcagcaatttctgctttttg

SEQ ID NO: 1279 - DNA, 58 bp, Artificial Sequence
  Description of Artificial Sequence: Synthetic oligonucleotide
ccggcaagatctaccggactgagatctcgagatctcagtccggtagatcttgtttttg

SEQ ID NO: 1280 - DNA, 58 bp, Artificial Sequence
  Description of Artificial Sequence: Synthetic oligonucleotide
ccggcctgaccctcatcatcttcatctcgagatgaagatgatgagggtcaggtttttg

SEQ ID NO: 1281 - DNA, 58 bp, Artificial Sequence
  Description of Artificial Sequence: Synthetic oligonucleotide
ccggcttcctctatgccacccagtactcgagtactgggtggcatagaggaagtttttg

SEQ ID NO: 1282 - DNA, 58 bp, Artificial Sequence
  Description of Artificial Sequence: Synthetic oligonucleotide
ccgggccctcactgagccacttaatctcgagattaagtggctcagtgagggctttttg

SEQ ID NO: 1283 - DNA, 58 bp, Artificial Sequence
  Description of Artificial Sequence: Synthetic oligonucleotide
ccggcccaagacagtgaaagtaattctcgagaattactttcactgtcttgggtttttg

SEQ ID NO: 1284 - DNA, 58 bp, Artificial Sequence; identical to SEQ ID NO: 1283
  Description of Artificial Sequence: Synthetic oligonucleotide

SEQ ID NO: 1285 - DNA, 58 bp, Artificial Sequence
  Description of Artificial Sequence: Synthetic oligonucleotide
ccggctgctgaaagtggcgcaaatgctcgagcatttgcgccactttcagcagtttttg

SEQ ID NO: 1286 - DNA, 58 bp, Artificial Sequence
  Description of Artificial Sequence: Synthetic oligonucleotide
ccggcaaagccctgtcctaatttatctcgagataaattaggacagggctttgtttttg

SEQ ID NO: 1287 - DNA, 58 bp, Artificial Sequence
  Description of Artificial Sequence: Synthetic oligonucleotide
ccggcctgtcgatctttggtttcatctcgagatgaaaccaaagatcgacaggtttttg

SEQ ID NO: 1288 - DNA, 58 bp, Artificial Sequence
  Description of Artificial Sequence: Synthetic oligonucleotide
ccggtgctggtatggacgcttattgctcgagcaataagcgtccataccagcatttttg

SEQ ID NO: 1289 - DNA, 58 bp, Artificial Sequence
  Description of Artificial Sequence: Synthetic oligonucleotide
ccgggcaaagtgttgtagcttataactcgagttataagctacaacactttgctttttg

SEQ ID NO: 1290 - DNA, 58 bp, Artificial Sequence
  Description of Artificial Sequence: Synthetic oligonucleotide
ccggatattcccagagaattgtattctcgagaatacaattctctgggaatattttttg

SEQ ID NO: 1291 - DNA, 58 bp, Artificial Sequence
  Description of Artificial Sequence: Synthetic oligonucleotide
ccgggtaacctctacaggcatttaactcgagttaaatgcctgtagaggttactttttg

SEQ ID NO: 1292 - DNA, 58 bp, Artificial Sequence
  Description of Artificial Sequence: Synthetic oligonucleotide
ccgggttgaaggactacaggtatttctcgagaaatacctgtagtccttcaactttttg

SEQ ID NO: 1293 - DNA, 58 bp, Artificial Sequence
  Description of Artificial Sequence: Synthetic oligonucleotide
ccggggtgacttccatcaagctatactcgagtatagcttgatggaagtcacctttttg

SEQ ID NO: 1294 - DNA, 58 bp, Artificial Sequence
  Description of Artificial Sequence: Synthetic oligonucleotide
ccggcattctcttcagacacaatttctcgagaaattgtgtctgaagagaatgtttttg

SEQ ID NO: 1295 - DNA, 58 bp, Artificial Sequence
  Description of Artificial Sequence: Synthetic oligonucleotide
ccgggcattctcttcagacacaattctcgagaattgtgtctgaagagaatgctttttg

SEQ ID NO: 1296 - DNA, 58 bp, Artificial Sequence
  Description of Artificial Sequence: Synthetic oligonucleotide
ccgggccgggaaggagtacattatcctcgaggataatgtactccttcccggctttttg

SEQ ID NO: 1297 - DNA, 58 bp, Artificial Sequence
  Description of Artificial Sequence: Synthetic oligonucleotide
ccggctaaggatcaccattactttactcgagtaaagtaatggtgatccttagtttttg

SEQ ID NO: 1298 - DNA, 58 bp, Artificial Sequence
  Description of Artificial Sequence: Synthetic oligonucleotide
ccggccagactattccacttaataactcgagttattaagtggaatagtctggtttttg

SEQ ID NO: 1299 - DNA, 58 bp, Artificial Sequence
  Description of Artificial Sequence: Synthetic oligonucleotide
ccggcagtctctgagaagtactttactcgagtaaagtacttctcagagactgtttttg

SEQ ID NO: 1300 - DNA, 58 bp, Artificial Sequence
  Description of Artificial Sequence: Synthetic oligonucleotide
ccggcgatgtactcacgctggatatctcgagatatccagcgtgagtacatcgtttttg

SEQ ID NO: 1301 - DNA, 58 bp, Artificial Sequence; identical to SEQ ID NO: 1300
  Description of Artificial Sequence: Synthetic oligonucleotide

SEQ ID NO: 1302 - DNA, 58 bp, Artificial Sequence
  Description of Artificial Sequence: Synthetic oligonucleotide
ccggcccagagaaacccgtcaacatctcgagatgttgacgggtttctctgggtttttg

SEQ ID NO: 1303 - DNA, 58 bp, Artificial Sequence
  Description of Artificial Sequence: Synthetic oligonucleotide
ccggtctcctggtacaagacataatctcgagattatgtcttgtaccaggagatttttg

SEQ ID NO: 1304 - DNA, 58 bp, Artificial Sequence
  Description of Artificial Sequence: Synthetic oligonucleotide
ccgggtcggcctgatttcccgtaaactcgagtttacgggaaatcaggccgactttttg

SEQ ID NO: 1305 - DNA, 58 bp, Artificial Sequence
  Description of Artificial Sequence: Synthetic oligonucleotide
ccggttgacaaggactggaatatttctcgagaaatattccagtccttgtcaatttttg

SEQ ID NO: 1306 - DNA, 58 bp, Artificial Sequence
  Description of Artificial Sequence: Synthetic oligonucleotide
ccgggtgaacagcaagttctataaactcgagtttatagaacttgctgttcactttttg

SEQ ID NO: 1307 - DNA, 58 bp, Artificial Sequence
  Description of Artificial Sequence: Synthetic oligonucleotide
ccggacaggagagagcgggactatactcgagtatagtcccgctctctcctgttttttg

SEQ ID NO: 1308 - DNA, 58 bp, Artificial Sequence
  Description of Artificial Sequence: Synthetic oligonucleotide
ccgggctgctattgtacaagtataactcgagttatacttgtacaatagcagctttttg

SEQ ID NO: 1309 - DNA, 58 bp, Artificial Sequence
  Description of Artificial Sequence: Synthetic oligonucleotide
ccggggagctgctctctcatgaaacctcgaggtttcatgagagagcagctcctttttg

SEQ ID NO: 1310 - DNA, 58 bp, Artificial Sequence
  Description of Artificial Sequence: Synthetic oligonucleotide
ccggcccagattatcacctttgaaactcgagtttcaaaggtgataatctgggtttttg

SEQ ID NO: 1311 - DNA, 58 bp, Artificial Sequence
  Description of Artificial Sequence: Synthetic oligonucleotide
ccgggaagtcatctcagaaatgtttctcgagaaacatttctgagatgacttctttttg

SEQ ID NO: 1312 - DNA, 58 bp, Artificial Sequence
  Description of Artificial Sequence: Synthetic oligonucleotide
ccgggtctatttaagcctcatatttctcgagaaatatgaggcttaaatagactttttg

SEQ ID NO: 1313 - DNA, 58 bp, Artificial Sequence
  Description of Artificial Sequence: Synthetic oligonucleotide
ccgggataggtaaataccaagtattctcgagaatacttggtatttacctatctttttg

SEQ ID NO: 1314 - DNA, 58 bp, Artificial Sequence
  Description of Artificial Sequence: Synthetic oligonucleotide
ccgggcttagagcaagtgaggaagactcgagtcttcctcacttgctctaagctttttg

SEQ ID NO: 1315 - DNA, 58 bp, Artificial Sequence
  Description of Artificial Sequence: Synthetic oligonucleotide
ccggcagccaggcctgcacataaatctcgagatttatgtgcaggcctggctgtttttg

SEQ ID NO: 1316 - DNA, 58 bp, Artificial Sequence
  Description of Artificial Sequence: Synthetic oligonucleotide
ccggctatgcctactctcaagaaatctcgagatttcttgagagtaggcatagtttttg

SEQ ID NO: 1317 - DNA, 58 bp, Artificial Sequence
  Description of Artificial Sequence: Synthetic oligonucleotide
ccggccagcttcactctgaagagttctcgagaactcttcagagtgaagctggtttttg

SEQ ID NO: 1318 - DNA, 58 bp, Artificial Sequence
  Description of Artificial Sequence: Synthetic oligonucleotide
ccgggagcagctgctccaggaatatctcgagatattcctggagcagctgctctttttg

SEQ ID NO: 1319 - DNA, 58 bp, Artificial Sequence
  Description of Artificial Sequence: Synthetic oligonucleotide
ccgggtctctccttccgcttctttgctcgagcaaagaagcggaaggagagactttttg

SEQ ID NO: 1320 - DNA, 58 bp, Artificial Sequence
  Description of Artificial Sequence: Synthetic oligonucleotide
ccggtgtctgtctgtctgctcttagctcgagctaagagcagacagacagacatttttg

SEQ ID NO: 1321 - DNA, 58 bp, Artificial Sequence
  Description of Artificial Sequence: Synthetic oligonucleotide
ccggcccggagctgtggtagtaattctcgagaattactaccacagctccgggtttttg

SEQ ID NO: 1322 - DNA, 58 bp, Artificial Sequence
  Description of Artificial Sequence: Synthetic oligonucleotide
ccgggctgctgccctaactcgaaatctcgagatttcgagttagggcagcagctttttg

SEQ ID NO: 1323 - DNA, 58 bp, Artificial Sequence
  Description of Artificial Sequence: Synthetic oligonucleotide
ccggcggtgtgacgaaatgcaacatctcgagatgttgcatttcgtcacaccgtttttg

SEQ ID NO: 1324 - DNA, 58 bp, Artificial Sequence
  Description of Artificial Sequence: Synthetic oligonucleotide
ccggtggcctgtgtctagttgtttgctcgagcaaacaactagacacaggccatttttg

SEQ ID NO: 1325 - DNA, 58 bp, Artificial Sequence
  Description of Artificial Sequence: Synthetic oligonucleotide
ccggtgggatccctcatcctcatacctcgaggtatgaggatgagggatcccatttttg

SEQ ID NO: 1326 - DNA, 58 bp, Artificial Sequence
  Description of Artificial Sequence: Synthetic oligonucleotide
ccgggctttgctcatccactatcaactcgagttgatagtggatgagcaaagctttttg

SEQ ID NO: 1327 - DNA, 58 bp, Artificial Sequence
  Description of Artificial Sequence: Synthetic oligonucleotide
ccggacctgcacactgtcctattatctcgagataataggacagtgtgcaggttttttg

SEQ ID NO: 1328 - DNA, 58 bp, Artificial Sequence
  Description of Artificial Sequence: Synthetic oligonucleotide
ccggagatgctgaacagtgacaaatctcgagatttgtcactgttcagcatcttttttg

SEQ ID NO: 1329 - DNA, 58 bp, Artificial Sequence
  Description of Artificial Sequence: Synthetic oligonucleotide
ccgggttctccagtcattatgttaactcgagttaacataatgactggagaactttttg

SEQ ID NO: 1330 - DNA, 58 bp, Artificial Sequence
  Description of Artificial Sequence: Synthetic oligonucleotide
ccgggtatatgtcaagccataattgctcgagcaattatggcttgacatatactttttg

SEQ ID NO: 1331 - DNA, 58 bp, Artificial Sequence
  Description of Artificial Sequence: Synthetic oligonucleotide
ccggactctaccctggcactataatctcgagattatagtgccagggtagagttttttg

SEQ ID NO: 1332 - DNA, 58 bp, Artificial Sequence
  Description of Artificial Sequence: Synthetic oligonucleotide
ccggcctgttaatccaaggtctttactcgagtaaagaccttggattaacaggtttttg

SEQ ID NO: 1333 - DNA, 58 bp, Artificial Sequence
  Description of Artificial Sequence: Synthetic oligonucleotide
ccgggctggttaccatcggagtttactcgagtaaactccgatggtaaccagctttttg

SEQ ID NO: 1334 - DNA, 58 bp, Artificial Sequence
  Description of Artificial Sequence: Synthetic oligonucleotide
ccgggcagtgaaagtggcagatattctcgagaatatctgccactttcactgctttttg

SEQ ID NO: 1335 - DNA, 58 bp, Artificial Sequence
  Description of Artificial Sequence: Synthetic oligonucleotide
ccgggaagcaagcaaggcttataatctcgagattataagccttgcttgcttctttttg

SEQ ID NO: 1336 - DNA, 58 bp, Artificial Sequence
  Description of Artificial Sequence: Synthetic oligonucleotide
ccgggcttagactaaggccattattctcgagaataatggccttagtctaagctttttg

SEQ ID NO: 1337 - DNA, 58 bp, Artificial Sequence
  Description of Artificial Sequence: Synthetic oligonucleotide
ccggctctcactataccagtataatctcgagattatactggtatagtgagagtttttg

SEQ ID NO: 1338 - DNA, 58 bp, Artificial Sequence
  Description of Artificial Sequence: Synthetic oligonucleotide
ccggcaaactgtgcccttcagattgctcgagcaatctgaagggcacagtttgtttttg

SEQ ID NO: 1339 - DNA, 58 bp, Artificial Sequence
  Description of Artificial Sequence: Synthetic oligonucleotide
ccgggattccctgatgctgatatttctcgagaaatatcagcatcagggaatctttttg

SEQ ID NO: 1340 - DNA, 58 bp, Artificial Sequence
  Description of Artificial Sequence: Synthetic oligonucleotide
ccggaggaatccatgtagtagatatctcgagatatctactacatggattccttttttg

SEQ ID NO: 1341 - DNA, 58 bp, Artificial Sequence
  Description of Artificial Sequence: Synthetic oligonucleotide
ccggaggtgttctggaggtctattactcgagtaatagacctccagaacaccttttttg

SEQ ID NO: 1342 - DNA, 58 bp, Artificial Sequence
  Description of Artificial Sequence: Synthetic oligonucleotide
ccggatttgtccatacgtcactatactcgagtatagtgacgtatggacaaattttttg

SEQ ID NO: 1343 - DNA, 58 bp, Artificial Sequence
  Description of Artificial Sequence: Synthetic oligonucleotide
ccggcaaaggactttgcagattaaactcgagtttaatctgcaaagtcctttgtttttg

SEQ ID NO: 1344 - DNA, 58 bp, Artificial Sequence
  Description of Artificial Sequence: Synthetic oligonucleotide
ccgggcgcagggtctacgaagaatactcgagtattcttcgtagaccctgcgctttttg

SEQ ID NO: 1345 - DNA, 58 bp, Artificial Sequence
  Description of Artificial Sequence: Synthetic oligonucleotide
ccggacatccagcctacacgtatttctcgagaaatacgtgtaggctggatgttttttg

SEQ ID NO: 1346 - DNA, 58 bp, Artificial Sequence
  Description of Artificial Sequence: Synthetic oligonucleotide
ccggtctgaaggtgcgaggattatactcgagtataatcctcgcaccttcagatttttg

SEQ ID NO: 1347 - DNA, 58 bp, Artificial Sequence
  Description of Artificial Sequence: Synthetic oligonucleotide
ccggtccagatctgccggttcattactcgagtaatgaaccggcagatctggatttttg

SEQ ID NO: 1348 - DNA, 58 bp, Artificial Sequence
  Description of Artificial Sequence: Synthetic oligonucleotide
ccgggcgcccactcttccaattaaactcgagtttaattggaagagtgggcgctttttg

SEQ ID NO: 1349 - DNA, 58 bp, Artificial Sequence
  Description of Artificial Sequence: Synthetic oligonucleotide
ccggtccagagcctgccagcaatttctcgagaaattgctggcaggctctggatttttg

SEQ ID NO: 1350 - DNA, 58 bp, Artificial Sequence
  Description of Artificial Sequence: Synthetic oligonucleotide
ccggagaatgtgagtgcaaagattgctcgagcaatctttgcactcacattcttttttg

SEQ ID NO: 1351 - DNA, 58 bp, Artificial Sequence
  Description of Artificial Sequence: Synthetic oligonucleotide
ccggcttgcacactctcccattatactcgagtataatgggagagtgtgcaagtttttg

SEQ ID NO: 1352 - DNA, 58 bp, Artificial Sequence
  Description of Artificial Sequence: Synthetic oligonucleotide
ccgggcagatattctctagtcatttctcgagaaatgactagagaatatctgctttttg

SEQ ID NO: 1353 - DNA, 58 bp, Artificial Sequence
  Description of Artificial Sequence: Synthetic oligonucleotide
ccggatttcttcgtgatgacatatcctcgaggatatgtcatcacgaagaaattttttg

SEQ ID NO: 1354 - DNA, 58 bp, Artificial Sequence
  Description of Artificial Sequence: Synthetic oligonucleotide
ccggttacgagggttctacttatttctcgagaaataagtagaaccctcgtaatttttg

SEQ ID NO: 1355 - DNA, 58 bp, Artificial Sequence
  Description of Artificial Sequence: Synthetic oligonucleotide
ccggatttagtgggagaccataatgctcgagcattatggtctcccactaaattttttg

SEQ ID NO: 1356 - DNA, 58 bp, Artificial Sequence
  Description of Artificial Sequence: Synthetic oligonucleotide
ccggactgacaggagagaagtaagactcgagtcttacttctctcctgtcagttttttg

SEQ ID NO: 1357 - DNA, 58 bp, Artificial Sequence
  Description of Artificial Sequence: Synthetic oligonucleotide
ccggtgaattgtaggtgactattatctcgagataatagtcacctacaattcatttttg

SEQ ID NO: 1358 - DNA, 58 bp, Artificial Sequence
  Description of Artificial Sequence: Synthetic oligonucleotide
ccggcagaccacgcaaggagttcatctcgagatgaactccttgcgtggtctgtttttg

SEQ ID NO: 1359 - DNA, 58 bp, Artificial Sequence
  Description of Artificial Sequence: Synthetic oligonucleotide
ccggcgggaaggaaatttgtcttgactcgagtcaagacaaatttccttcccgtttttg

SEQ ID NO: 1360 - DNA, 58 bp, Artificial Sequence
  Description of Artificial Sequence: Synthetic oligonucleotide
ccggtttaccctaggatgctatttactcgagtaaatagcatcctagggtaaatttttg

SEQ ID NO: 1361 - DNA, 58 bp, Artificial Sequence
  Description of Artificial Sequence: Synthetic oligonucleotide
ccgggttgcacttgtttacgcgttactcgagtaacgcgtaaacaagtgcaactttttg

SEQ ID NO: 1362 - DNA, 58 bp, Artificial Sequence
  Description of Artificial Sequence: Synthetic oligonucleotide
ccgggctgtggatttcgtatggaaactcgagtttccatacgaaatccacagctttttg

SEQ ID NO: 1363 - DNA, 58 bp, Artificial Sequence
  Description of Artificial Sequence: Synthetic oligonucleotide
ccggtgcgccaacacagaaattattctcgagaataatttctgtgttggcgcatttttg

SEQ ID NO: 1364 - DNA, 58 bp, Artificial Sequence
  Description of Artificial Sequence: Synthetic oligonucleotide
ccggcaagagaatatccgaactttactcgagtaaagttcggatattctcttgtttttg

SEQ ID NO: 1365 - DNA, 58 bp, Artificial Sequence
  Description of Artificial Sequence: Synthetic oligonucleotide
ccggtgcacgggagaatatacaaatctcgagatttgtatattctcccgtgcatttttg

SEQ ID NO: 1366 - DNA, 58 bp, Artificial Sequence
  Description of Artificial Sequence: Synthetic oligonucleotide
ccggccaaaggaggatggcatataactcgagttatatgccatcctcctttggtttttg

SEQ ID NO: 1367 - DNA, 58 bp, Artificial Sequence
  Description of Artificial Sequence: Synthetic oligonucleotide
ccggccaaacgttaagaattgttaactcgagttaacaattcttaacgtttggtttttg

SEQ ID NO: 1368 - DNA, 58 bp, Artificial Sequence
  Description of Artificial Sequence: Synthetic oligonucleotide
ccgggatgtgaaggaactgattaaactcgagtttaatcagttccttcacatctttttg

SEQ ID NO: 1369 - DNA, 58 bp, Artificial Sequence
  Description of Artificial Sequence: Synthetic oligonucleotide
ccggcttggcacgtcatcgtgttacctcgaggtaacacgatgacgtgccaagtttttg

SEQ ID NO: 1370 - DNA, 58 bp, Artificial Sequence
  Description of Artificial Sequence: Synthetic oligonucleotide
ccggacccactaactggctaattagctcgagctaattagccagttagtgggttttttg

SEQ ID NO: 1371 - DNA, 58 bp, Artificial Sequence
  Description of Artificial Sequence: Synthetic oligonucleotide
ccgggagacactcaacaagtatgttctcgagaacatacttgttgagtgtctctttttg

SEQ ID NO: 1372 - DNA, 58 bp, Artificial Sequence
  Description of Artificial Sequence: Synthetic oligonucleotide
ccgggaagcgctacttggtcaaattctcgagaatttgaccaagtagcgcttctttttg

SEQ ID NO: 1373 - DNA, 58 bp, Artificial Sequence
  Description of Artificial Sequence: Synthetic oligonucleotide
ccgggccactaaattgacacttaaactcgagtttaagtgtcaatttagtggctttttg

SEQ ID NO: 1374 - DNA, 58 bp, Artificial Sequence
  Description of Artificial Sequence: Synthetic oligonucleotide
ccggccctggaaatcaacaagtattctcgagaatacttgttgatttccagggtttttg

SEQ ID NO: 1375 - DNA, 58 bp, Artificial Sequence
  Description of Artificial Sequence: Synthetic oligonucleotide
ccggccttctcatttggaaactaaactcgagtttagtttccaaatgagaaggtttttg

SEQ ID NO: 1376 - DNA, 58 bp, Artificial Sequence
  Description of Artificial Sequence: Synthetic oligonucleotide
ccggcgctacctgaacatagttcatctcgagatgaactatgttcaggtagcgtttttg

SEQ ID NO: 1377 - DNA, 58 bp, Artificial Sequence
  Description of Artificial Sequence: Synthetic oligonucleotide
ccgggagtacaaggcatggcgtagactcgagtctacgccatgccttgtactctttttg

SEQ ID NO: 1378 - DNA, 58 bp, Artificial Sequence
  Description of Artificial Sequence: Synthetic oligonucleotide
ccggctattcccgacttcatctttgctcgagcaaagatgaagtcgggaatagtttttg

SEQ ID NO: 1379 - DNA, 58 bp, Artificial Sequence
  Description of Artificial Sequence: Synthetic oligonucleotide
ccgggcgtgtagtgaatcacgtaaactcgagtttacgtgattcactacacgctttttg

SEQ ID NO: 1380 - DNA, 58 bp, Artificial Sequence
  Description of Artificial Sequence: Synthetic oligonucleotide
ccggcctgttcttaagacgtgatttctcgagaaatcacgtcttaagaacaggtttttg

SEQ ID NO: 1381 - DNA, 58 bp, Artificial Sequence
  Description of Artificial Sequence: Synthetic oligonucleotide
ccgggcttgctcatctgggtgatatctcgagatatcacccagatgagcaagctttttg

SEQ ID NO: 1382 - DNA, 58 bp, Artificial Sequence
  Description of Artificial Sequence: Synthetic oligonucleotide
ccggtactgggcatctacactattactcgagtaatagtgtagatgcccagtatttttg

SEQ ID NO: 1383 - DNA, 58 bp, Artificial Sequence
  Description of Artificial Sequence: Synthetic oligonucleotide
ccggttatctatggcaatgtctttactcgagtaaagacattgccatagataatttttg

SEQ ID NO: 1384 - DNA, 58 bp, Artificial Sequence
  Description of Artificial Sequence: Synthetic oligonucleotide
ccggtgaactgtcactgtgagatatctcgagatatctcacagtgacagttcatttttg

SEQ ID NO: 1385 - DNA, 58 bp, Artificial Sequence
  Description of Artificial Sequence: Synthetic oligonucleotide
ccggatgtactactctctcctttacctcgaggtaaaggagagagtagtacattttttg

SEQ ID NO: 1386 - DNA, 58 bp, Artificial Sequence
  Description of Artificial Sequence: Synthetic oligonucleotide
ccgggcctttcataacagagcacatctcgagatgtgctctgttatgaaaggctttttg

SEQ ID NO: 1387 - DNA, 58 bp, Artificial Sequence
  Description of Artificial Sequence: Synthetic oligonucleotide
ccggccatgagaaacagcgtcaaatctcgagatttgacgctgtttctcatggtttttg

SEQ ID NO: 1388 - DNA, 58 bp, Artificial Sequence
  Description of Artificial Sequence: Synthetic oligonucleotide
ccgggctcgtccctgatggataaagctcgagctttatccatcagggacgagctttttg

SEQ ID NO: 1389 - DNA, 58 bp, Artificial Sequence
  Description of Artificial Sequence: Synthetic oligonucleotide
ccggagacaagaagtgctggaatttctcgagaaattccagcacttcttgtcttttttg

SEQ ID NO: 1390 - DNA, 58 bp, Artificial Sequence
  Description of Artificial Sequence: Synthetic oligonucleotide
ccgggcactgcgtggcgaatgtaaactcgagtttacattcgccacgcagtgctttttg

SEQ ID NO: 1391 - DNA, 58 bp, Artificial Sequence
  Description of Artificial Sequence: Synthetic oligonucleotide
ccggtgctcaacgacatcgtgattcctcgaggaatcacgatgtcgttgagcatttttg

SEQ ID NO: 1392 - DNA, 58 bp, Artificial Sequence
  Description of Artificial Sequence: Synthetic oligonucleotide
ccggcaacgggctaatccacggaatctcgagattccgtggattagcccgttgtttttg

SEQ ID NO: 1393 - DNA, 58 bp, Artificial Sequence
  Description of Artificial Sequence: Synthetic oligonucleotide
ccgggcaggtgtcagcaagtatgatctcgagatcatacttgctgacacctgctttttg

SEQ ID NO: 1394 - DNA, 58 bp, Artificial Sequence; identical to SEQ ID NO: 1393
  Description of Artificial Sequence: Synthetic oligonucleotide

SEQ ID NO: 1395 - DNA, 58 bp, Artificial Sequence
  Description of Artificial Sequence: Synthetic oligonucleotide
ccgggtcttgcagaaacagtccattctcgagaatggactgtttctgcaagactttttg

SEQ ID NO: 1396 - DNA, 58 bp, Artificial Sequence
  Description of Artificial Sequence: Synthetic oligonucleotide
ccggcccagacaccaaagttaatttctcgagaaattaactttggtgtctgggtttttg

SEQ ID NO: 1397 - DNA, 58 bp, Artificial Sequence
  Description of Artificial Sequence: Synthetic oligonucleotide
ccggtgcagctgcatgtggataaagctcgagctttatccacatgcagctgcatttttg

SEQ ID NO: 1398 - DNA, 58 bp, Artificial Sequence
  Description of Artificial Sequence: Synthetic oligonucleotide
ccggagagcaactctgagatctaagctcgagcttagatctcagagttgctcttttttg

SEQ ID NO: 1399 - DNA, 58 bp, Artificial Sequence
  Description of Artificial Sequence: Synthetic oligonucleotide
ccggttggaactcccttccgaaattctcgagaatttcggaagggagttccaatttttg

SEQ ID NO: 1400 - DNA, 58 bp, Artificial Sequence
  Description of Artificial Sequence: Synthetic oligonucleotide
ccggtaaatccaacagcccatatttctcgagaaatatgggctgttggatttatttttg

SEQ ID NO: 1401 - DNA, 58 bp, Artificial Sequence
  Description of Artificial Sequence: Synthetic oligonucleotide
ccggtcaggtctagctgggtatttactcgagtaaatacccagctagacctgatttttg

SEQ ID NO: 1402 - DNA, 58 bp, Artificial Sequence
  Description of Artificial Sequence: Synthetic oligonucleotide
ccggcttggtgtgtgcatgagtattctcgagaatactcatgcacacaccaagtttttg

SEQ ID NO: 1403 - DNA, 58 bp, Artificial Sequence
  Description of Artificial Sequence: Synthetic oligonucleotide
ccgggaggagatgtggcaccatttactcgagtaaatggtgccacatctcctctttttg

SEQ ID NO: 1404 - DNA, 58 bp, Artificial Sequence
  Description of Artificial Sequence: Synthetic oligonucleotide
ccgggccatacaagatggaacaatactcgagtattgttccatcttgtatggctttttg

SEQ ID NO: 1405 - DNA, 58 bp, Artificial Sequence
  Description of Artificial Sequence: Synthetic oligonucleotide
ccggcacctagtgaaattccttaaactcgagtttaaggaatttcactaggtgtttttg

SEQ ID NO: 1406 - DNA, 58 bp, Artificial Sequence
  Description of Artificial Sequence: Synthetic oligonucleotide
ccggcatgtactctggagatgttatctcgagataacatctccagagtacatgtttttg

SEQ ID NO: 1407 - DNA, 58 bp, Artificial Sequence
  Description of Artificial Sequence: Synthetic oligonucleotide
ccggcaatgtgggcagaggcctaaactcgagtttaggcctctgcccacattgtttttg

SEQ ID NO: 1408 - DNA, 58 bp, Artificial Sequence
  Description of Artificial Sequence: Synthetic oligonucleotide
ccgggcgtatgacacattgattaaactcgagtttaatcaatgtgtcatacgctttttg

SEQ ID NO: 1409 - DNA, 58 bp, Artificial Sequence
  Description of Artificial Sequence: Synthetic oligonucleotide
ccggcctgaaacagtggcaataaatctcgagatttattgccactgtttcaggtttttg

SEQ ID NO: 1410 - DNA, 58 bp, Artificial Sequence
  Description of Artificial Sequence: Synthetic oligonucleotide
ccggctatcatcctcaaggacattactcgagtaatgtccttgaggatgatagtttttg

SEQ ID NO: 1411 - DNA, 58 bp, Artificial Sequence
  Description of Artificial Sequence: Synthetic oligonucleotide
ccgggactagaggcttgcataataactcgagttattatgcaagcctctagtctttttg

SEQ ID NO: 1412 - DNA, 58 bp, Artificial Sequence
  Description of Artificial Sequence: Synthetic oligonucleotide
ccggactgggctgtactttgtatatctcgagatatacaaagtacagcccagttttttg

SEQ ID NO: 1413 - DNA, 58 bp, Artificial Sequence
  Description of Artificial Sequence: Synthetic oligonucleotide
ccggtgagctctctctggtcaatttctcgagaaattgaccagagagagctcatttttg

SEQ ID NO: 1414 - DNA, 58 bp, Artificial Sequence
  Description of Artificial Sequence: Synthetic oligonucleotide
ccgggaaacgaactgggcagtataactcgagttatactgcccagttcgtttctttttg

SEQ ID NO: 1415 - DNA, 58 bp, Artificial Sequence
  Description of Artificial Sequence: Synthetic oligonucleotide
ccggtatagctcagtttggataattctcgagaattatccaaactgagctatatttttg

SEQ ID NO: 1416 - DNA, 58 bp, Artificial Sequence
  Description of Artificial Sequence: Synthetic oligonucleotide
ccggtgaacgattggaatctaataactcgagttattagattccaatcgttcatttttg

SEQ ID NO: 1417 - DNA, 58 bp, Artificial Sequence
  Description of Artificial Sequence: Synthetic oligonucleotide
ccggctgtctgactacctgcttcaactcgagttgaagcaggtagtcagacagtttttg

SEQ ID NO: 1418 - DNA, 58 bp, Artificial Sequence
  Description of Artificial Sequence: Synthetic oligonucleotide
ccggtcctccgacttcgctgtcaaactcgagtttgacagcgaagtcggaggatttttg

SEQ ID NO: 1419 - DNA, 58 bp, Artificial Sequence
  Description of Artificial Sequence: Synthetic oligonucleotide
ccgggcttcgtccagaccaacatctctcgagagatgttggtctggacgaagctttttg

SEQ ID NO: 1420 - DNA, 58 bp, Artificial Sequence
  Description of Artificial Sequence: Synthetic oligonucleotide
ccggagctggagttccgcaagaaacctcgaggtttcttgcggaactccagcttttttg

SEQ ID NO: 1421 - DNA, 58 bp, Artificial Sequence
  Description of Artificial Sequence: Synthetic oligonucleotide
ccggtcctacccactgctggcaaatctcgagatttgccagcagtgggtaggatttttg

SEQ ID NO: 1422 - DNA, 58 bp, Artificial Sequence
  Description of Artificial Sequence: Synthetic oligonucleotide
ccggtgtccctcactcaacacaaacctcgaggtttgtgttgagtgagggacatttttg

SEQ ID NO: 1423 - DNA, 58 bp, Artificial Sequence
  Description of Artificial Sequence: Synthetic oligonucleotide
ccggcacacgcatgtttgccttcttctcgagaagaaggcaaacatgcgtgtgtttttg

SEQ ID NO: 1424 - DNA, 58 bp, Artificial Sequence
  Description of Artificial Sequence: Synthetic oligonucleotide
ccggcgtgtgtgattgcctgttattctcgagaataacaggcaatcacacacgtttttg

SEQ ID NO: 1425 - DNA, 58 bp, Artificial Sequence
  Description of Artificial Sequence: Synthetic oligonucleotide
ccggtctcagtatgtgctataatatctcgagatattatagcacatactgagatttttg

SEQ ID NO: 1426 - DNA, 58 bp, Artificial Sequence
  Description of Artificial Sequence: Synthetic oligonucleotide
ccggttctcagtatgtgctataatactcgagtattatagcacatactgagaatttttg

SEQ ID NO: 1427 - DNA, 58 bp, Artificial Sequence
  Description of Artificial Sequence: Synthetic oligonucleotide
ccggagcctaaacgcgatggatatactcgagtatatccatcgcgtttaggcttttttg

SEQ ID NO: 1428 - DNA, 58 bp, Artificial Sequence
  Description of Artificial Sequence: Synthetic oligonucleotide
ccggcccaagaacagctcgtttaacctcgaggttaaacgagctgttcttgggtttttg

SEQ ID NO: 1429 - DNA, 58 bp, Artificial Sequence
  Description of Artificial Sequence: Synthetic oligonucleotide
ccgggccaagaagtttaaggaatatctcgagatattccttaaacttcttggctttttg

SEQ ID NO: 1430 - DNA, 58 bp, Artificial Sequence
  Description of Artificial Sequence: Synthetic oligonucleotide
ccggccctgtaattgttgtttgtatctcgagatacaaacaacaattacagggtttttg

SEQ ID NO: 1431 - DNA, 58 bp, Artificial Sequence
  Description of Artificial Sequence: Synthetic oligonucleotide
ccggccagatgagtacctgacatacctcgaggtatgtcaggtactcatctggtttttg

SEQ ID NO: 1432 - DNA, 58 bp, Artificial Sequence
  Description of Artificial Sequence: Synthetic oligonucleotide
ccggcgacgaaaggcatgtaccatactcgagtatggtacatgcctttcgtcgtttttg

SEQ ID NO: 1433 - DNA, 58 bp, Artificial Sequence; identical to SEQ ID NO: 1432
  Description of Artificial Sequence: Synthetic oligonucleotide

SEQ ID NO: 1434 - DNA, 58 bp, Artificial Sequence
  Description of Artificial Sequence: Synthetic oligonucleotide
ccgggttcaccaagctcaacatttactcgagtaaatgttgagcttggtgaactttttg

SEQ ID NO: 1435 - DNA, 58 bp, Artificial Sequence
  Description of Artificial Sequence: Synthetic oligonucleotide
ccgggagttcaccaagctcaacattctcgagaatgttgagcttggtgaactctttttg

SEQ ID NO: 1436 - DNA, 58 bp, Artificial Sequence
  Description of Artificial Sequence: Synthetic oligonucleotide
ccggcccttatgaacctctactggtctcgagaccagtagaggttcataagggtttttg

SEQ ID NO: 1437 - DNA, 58 bp, Artificial Sequence
  Description of Artificial Sequence: Synthetic oligonucleotide
ccggcaggataatcgtggtgtaaatctcgagatttacaccacgattatcctgtttttg

SEQ ID NO: 1438 - DNA, 58 bp, Artificial Sequence
  Description of Artificial Sequence: Synthetic oligonucleotide
ccggcgaccagaaggccgtgtatttctcgagaaatacacggccttctggtcgtttttg

SEQ ID NO: 1439 - DNA, 58 bp, Artificial Sequence
  Description of Artificial Sequence: Synthetic oligonucleotide
ccggctgtccgccagtgcatcattactcgagtaatgatgcactggcggacagtttttg

SEQ ID NO: 1440 - DNA, 58 bp, Artificial Sequence
  Description of Artificial Sequence: Synthetic oligonucleotide
ccggcctgcagatcttgcgactaaactcgagtttagtcgcaagatctgcaggtttttg

SEQ ID NO: 1441 - DNA, 58 bp, Artificial Sequence
  Description of Artificial Sequence: Synthetic oligonucleotide
ccgggatcgctgtggctgctcttaactcgagttaagagcagccacagcgatctttttg

SEQ ID NO: 1442 - DNA, 58 bp, Artificial Sequence
  Description of Artificial Sequence: Synthetic oligonucleotide
ccgggagatgtagagacagtgatagctcgagctatcactgtctctacatctctttttg

SEQ ID NO: 1443 - DNA, 58 bp, Artificial Sequence
  Description of Artificial Sequence: Synthetic oligonucleotide
ccggagactccagattccgagagttctcgagaactctcggaatctggagtcttttttg

SEQ ID NO: 1444 - DNA, 58 bp, Artificial Sequence
  Description of Artificial Sequence: Synthetic oligonucleotide
ccgggctccagacctatgatgacttctcgagaagtcatcataggtctggagctttttg

SEQ ID NO: 1445 - DNA, 58 bp, Artificial Sequence
  Description of Artificial Sequence: Synthetic oligonucleotide
ccggagagctgggaagattcgaacactcgagtgttcgaatcttcccagctcttttttg

SEQ ID NO: 1446 - DNA, 58 bp, Artificial Sequence
  Description of Artificial Sequence: Synthetic oligonucleotide
ccggcaacaggtacacgtccgataactcgagttatcggacgtgtacctgttgtttttg

SEQ ID NO: 1447 - DNA, 58 bp, Artificial Sequence
  Description of Artificial Sequence: Synthetic oligonucleotide
ccggtgaaaggaagcgtggtcatttctcgagaaatgaccacgcttcctttcatttttg

SEQ ID NO: 1448 - DNA, 58 bp, Artificial Sequence
  Description of Artificial Sequence: Synthetic oligonucleotide
ccggtatgaagcctacgagtgtaagctcgagcttacactcgtaggcttcatatttttg

SEQ ID NO: 1449 - DNA, 58 bp, Artificial Sequence
  Description of Artificial Sequence: Synthetic oligonucleotide
ccggaccgtcaccagctattcattactcgagtaatgaatagctggtgacggttttttg

SEQ ID NO: 1450 - DNA, 58 bp, Artificial Sequence
  Description of Artificial Sequence: Synthetic oligonucleotide
ccggctctcaacagctccaattatgctcgagcataattggagctgttgagagtttttg

SEQ ID NO: 1451 - DNA, 58 bp, Artificial Sequence
  Description of Artificial Sequence: Synthetic oligonucleotide
ccggttgggccaggcagtccaatttctcgagaaattggactgcctggcccaatttttg

SEQ ID NO: 1452 - DNA, 58 bp, Artificial Sequence
  Description of Artificial Sequence: Synthetic oligonucleotide
ccggcaacaccatcaccagctttatctcgagataaagctggtgatggtgttgtttttg

SEQ ID NO: 1453 - DNA, 58 bp, Artificial Sequence
  Description of Artificial Sequence: Synthetic oligonucleotide
ccggatgagactcagcccaccatttctcgagaaatggtgggctgagtctcattttttg

SEQ ID NO: 1454 - DNA, 58 bp, Artificial Sequence
  Description of Artificial Sequence: Synthetic oligonucleotide
ccggtgagtgtgacttgggctaaagctcgagctttagcccaagtcacactcatttttg

SEQ ID NO: 1455 - DNA, 58 bp, Artificial Sequence
  Description of Artificial Sequence: Synthetic oligonucleotide
ccgggactcccatcagcattctatactcgagtatagaatgctgatgggagtctttttg

SEQ ID NO: 1456 - DNA, 58 bp, Artificial Sequence
  Description of Artificial Sequence: Synthetic oligonucleotide
ccggcgagtacatgctgtcaatctactcgagtagattgacagcatgtactcgtttttg

SEQ ID NO: 1457 - DNA, 58 bp, Artificial Sequence
  Description of Artificial Sequence: Synthetic oligonucleotide
ccggcagtcttccaagtcggctaatctcgagattagccgacttggaagactgtttttg

SEQ ID NO: 1458 - DNA, 58 bp, Artificial Sequence
  Description of Artificial Sequence: Synthetic oligonucleotide
ccgggcagaggaaagagagcttattctcgagaataagctctctttcctctgctttttg

SEQ ID NO: 1459 - DNA, 58 bp, Artificial Sequence
  Description of Artificial Sequence: Synthetic oligonucleotide
ccgggttcgacgtgtccagccttaactcgagttaaggctggacacgtcgaactttttg

SEQ ID NO: 1460 - DNA, 58 bp, Artificial Sequence
  Description of Artificial Sequence: Synthetic oligonucleotide
ccggccacttcatgatgtcgctttactcgagtaaagcgacatcatgaagtggtttttg

SEQ ID NO: 1461 - DNA, 58 bp, Artificial Sequence
  Description of Artificial Sequence: Synthetic oligonucleotide
ccgggatggctcaattgcctataaactcgagtttataggcaattgagccatctttttg

SEQ ID NO: 1462 - DNA, 58 bp, Artificial Sequence
  Description of Artificial Sequence: Synthetic oligonucleotide
ccggccatcagtggaactgctatttctcgagaaatagcagttccactgatggtttttg

SEQ ID NO: 1463 - DNA, 58 bp, Artificial Sequence
  Description of Artificial Sequence: Synthetic oligonucleotide
ccgggagtgaatacttcagacaattctcgagaattgtctgaagtattcactctttttg

SEQ ID NO: 1464 - DNA, 58 bp, Artificial Sequence
  Description of Artificial Sequence: Synthetic oligonucleotide
ccggcgtctggtatgtctccaacatctcgagatgttggagacataccagacgtttttg

SEQ ID NO: 1465 - DNA, 58 bp, Artificial Sequence; identical to SEQ ID NO: 1464
  Description of Artificial Sequence: Synthetic oligonucleotide

SEQ ID NO: 1466 - DNA, 58 bp, Artificial Sequence
  Description of Artificial Sequence: Synthetic oligonucleotide
ccgggcggatgttcaatggtgagaactcgagttctcaccattgaacatccgctttttg

SEQ ID NO: 1467 - DNA, 58 bp, Artificial Sequence
  Description of Artificial Sequence: Synthetic oligonucleotide
ccgggcagtgtcgttgcatatccatctcgagatggatatgcaacgacactgctttttg

SEQ ID NO: 1468 - DNA, 58 bp, Artificial Sequence
  Description of Artificial Sequence: Synthetic oligonucleotide
ccggacagccacctaccaagaagaactcgagttcttcttggtaggtggctgttttttg

SEQ ID NO: 1469 - DNA, 58 bp, Artificial Sequence
  Description of Artificial Sequence: Synthetic oligonucleotide
ccggcaacagtcgcaccatcatcaactcgagttgatgatggtgcgactgttgtttttg

SEQ ID NO: 1470 - DNA, 58 bp, Artificial Sequence
  Description of Artificial Sequence: Synthetic oligonucleotide
ccgggctgtgaaggaaggaaatttactcgagtaaatttccttccttcacagctttttg

SEQ ID NO: 1471 - DNA, 58 bp, Artificial Sequence
  Description of Artificial Sequence: Synthetic oligonucleotide
ccggcaaggtgcatttctgtcatttctcgagaaatgacagaaatgcaccttgtttttg

SEQ ID NO: 1472 - DNA, 58 bp, Artificial Sequence
  Description of Artificial Sequence: Synthetic oligonucleotide
ccggcggaagtagacgtaacttattctcgagaataagttacgtctacttccgtttttg

SEQ ID NO: 1473 - DNA, 58 bp, Artificial Sequence
  Description of Artificial Sequence: Synthetic oligonucleotide
ccgggccctgatagtcagttcgaatctcgagattcgaactgactatcagggctttttg

SEQ ID NO: 1474 - DNA, 58 bp, Artificial Sequence; identical to SEQ ID NO: 1473
  Description of Artificial Sequence: Synthetic oligonucleotide

SEQ ID NO: 1475 - DNA, 58 bp, Artificial Sequence
  Description of Artificial Sequence: Synthetic oligonucleotide
ccggcttccaaagatcaggtaacaactcgagttgttacctgatctttggaagtttttg

SEQ ID NO: 1476 - DNA, 58 bp, Artificial Sequence
  Description of Artificial Sequence: Synthetic oligonucleotide
ccggacagacacttcgggactcaatctcgagattgagtcccgaagtgtctgttttttg

SEQ ID NO: 1477 - DNA, 58 bp, Artificial Sequence
  Description of Artificial Sequence: Synthetic oligonucleotide
ccggccagcccaaatcctatttcaactcgagttgaaataggatttgggctggtttttg

SEQ ID NO: 1478 - DNA, 58 bp, Artificial Sequence
  Description of Artificial Sequence: Synthetic oligonucleotide
ccggccagaggccatttcataggttctcgagaacctatgaaatggcctctggtttttg

SEQ ID NO: 1479 - DNA, 58 bp, Artificial Sequence
  Description of Artificial Sequence: Synthetic oligonucleotide
ccgggacatgatcattagccataagctcgagcttatggctaatgatcatgtctttttg

SEQ ID NO: 1480 - DNA, 58 bp, Artificial Sequence
  Description of Artificial Sequence: Synthetic oligonucleotide
ccgggcctacattggcacaactatactcgagtatagttgtgccaatgtaggctttttg

SEQ ID NO: 1481 - DNA, 58 bp, Artificial Sequence
  Description of Artificial Sequence: Synthetic oligonucleotide
ccgggaagctcaccatcatatttaactcgagttaaatatgatggtgagcttctttttg

SEQ ID NO: 1482 - DNA, 58 bp, Artificial Sequence
  Description of Artificial Sequence: Synthetic oligonucleotide
ccgggatgcagcttatacgaaataactcgagttatttcgtataagctgcatctttttg

SEQ ID NO: 1483 - DNA, 58 bp, Artificial Sequence
  Description of Artificial Sequence: Synthetic oligonucleotide
ccgggttggtgcacagcacaaattactcgagtaatttgtgctgtgcaccaactttttg

SEQ ID NO: 1484 - DNA, 58 bp, Artificial Sequence
  Description of Artificial Sequence: Synthetic oligonucleotide
ccggagaagatgatgatgatgaatactcgagtattcatcatcatcatcttcttttttg

SEQ ID NO: 1485 - DNA, 58 bp, Artificial Sequence
  Description of Artificial Sequence: Synthetic oligonucleotide
ccggcctgccagtacctcaaagattctcgagaatctttgaggtactggcaggtttttg

SEQ ID NO: 1486 - DNA, 58 bp, Artificial Sequence; identical to SEQ ID NO: 1485
  Description of Artificial Sequence: Synthetic oligonucleotide

SEQ ID NO: 1487 - DNA, 58 bp, Artificial Sequence
  Description of Artificial Sequence: Synthetic oligonucleotide
ccggctggacctgaatgcctttgatctcgagatcaaaggcattcaggtccagtttttg

SEQ ID NO: 1488 - DNA, 58 bp, Artificial Sequence
  Description of Artificial Sequence: Synthetic oligonucleotide
ccgggtccagctcacgaggcaaatactcgagtatttgcctcgtgagctggactttttg

SEQ ID NO: 1489 - DNA, 58 bp, Artificial Sequence
  Description of Artificial Sequence: Synthetic oligonucleotide
ccggccagctcaacttcagctaaatctcgagatttagctgaagttgagctggtttttg

SEQ ID NO: 1490 - DNA, 58 bp, Artificial Sequence
  Description of Artificial Sequence: Synthetic oligonucleotide
ccgggcacttgaaatggaaagataactcgagttatctttccatttcaagtgctttttg

SEQ ID NO: 1491 - DNA, 58 bp, Artificial Sequence
  Description of Artificial Sequence: Synthetic oligonucleotide
ccgggagcggcagttaccatgttagctcgagctaacatggtaactgccgctctttttg

SEQ ID NO: 1492 - DNA, 58 bp, Artificial Sequence
  Description of Artificial Sequence: Synthetic oligonucleotide
ccgggcacgaccctaacggtgaatactcgagtattcaccgttagggtcgtgctttttg

SEQ ID NO: 1493 - DNA, 58 bp, Artificial Sequence
  Description of Artificial Sequence: Synthetic oligonucleotide
ccgggtccgcatttcactatcatacctcgaggtatgatagtgaaatgcggactttttg

SEQ ID NO: 1494 - DNA, 58 bp, Artificial Sequence
  Description of Artificial Sequence: Synthetic oligonucleotide
ccggccattctcatgccaactattactcgagtaatagttggcatgagaatggtttttg

SEQ ID NO: 1495 - DNA, 58 bp, Artificial Sequence
  Description of Artificial Sequence: Synthetic oligonucleotide
ccggcacagatgtgaccctataatactcgagtattatagggtcacatctgtgtttttg

SEQ ID NO: 1496 - DNA, 58 bp, Artificial Sequence
  Description of Artificial Sequence: Synthetic oligonucleotide
ccggtgtaaagaagtgtcgtgtatactcgagtatacacgacacttctttacatttttg

SEQ ID NO: 1497 - DNA, 58 bp, Artificial Sequence
  Description of Artificial Sequence: Synthetic oligonucleotide
ccggataaccacgacgcgttgaatcctcgaggattcaacgcgtcgtggttattttttg

SEQ ID NO: 1498 - DNA, 58 bp, Artificial Sequence
  Description of Artificial Sequence: Synthetic oligonucleotide
ccggcctgggacaaatgggaagaatctcgagattcttcccatttgtcccaggtttttg

SEQ ID NO: 1499 - DNA, 58 bp, Artificial Sequence
  Description of Artificial Sequence: Synthetic oligonucleotide
ccggctgggctgtaatctgtctcaactcgagttgagacagattacagcccagtttttg

SEQ ID NO: 1500 - DNA, 58 bp, Artificial Sequence
  Description of Artificial Sequence: Synthetic oligonucleotide
ccggcctgaataacaggaggactttctcgagaaagtcctcctgttattcaggtttttg

SEQ ID NO: 1501 - DNA, 58 bp, Artificial Sequence
  Description of Artificial Sequence: Synthetic oligonucleotide
ccgggcagcagaccttcaatctcttctcgagaagagattgaaggtctgctgctttttg

SEQ ID NO: 1502 - DNA, 58 bp, Artificial Sequence
  Description of Artificial Sequence: Synthetic oligonucleotide
ccggtgtaaagaagcatcgtgtttactcgagtaaacacgatgcttctttacatttttg

SEQ ID NO: 1503 - DNA, 58 bp, Artificial Sequence
  Description of Artificial Sequence: Synthetic oligonucleotide
ccggatgatcctcattgattaatacctcgaggtattaatcaatgaggatcattttttg

SEQ ID NO: 1504 - DNA, 58 bp, Artificial Sequence
  Description of Artificial Sequence: Synthetic oligonucleotide
ccggcctgaaggacagatatgatttctcgagaaatcatatctgtccttcaggtttttg

SEQ ID NO: 1505 - DNA, 58 bp, Artificial Sequence
  Description of Artificial Sequence: Synthetic oligonucleotide
ccgggcacagtggttaatgtaataactcgagttattacattaaccactgtgctttttg

SEQ ID NO: 1506 - DNA, 58 bp, Artificial Sequence
  Description of Artificial Sequence: Synthetic oligonucleotide
ccggtatgaccatgacacgatttaactcgagttaaatcgtgtcatggtcatatttttg

SEQ ID NO: 1507 - DNA, 58 bp, Artificial Sequence
  Description of Artificial Sequence: Synthetic oligonucleotide
ccggccatgctgactgatccattatctcgagataatggatcagtcagcatggtttttg

SEQ ID NO: 1508 - DNA, 58 bp, Artificial Sequence
  Description of Artificial Sequence: Synthetic oligonucleotide
ccggacttgggatgagacacttctactcgagtagaagtgtctcatcccaagttttttg

SEQ ID NO: 1509 - DNA, 58 bp, Artificial Sequence
  Description of Artificial Sequence: Synthetic oligonucleotide
ccggagtggaagacactcctctgatctcgagatcagaggagtgtcttccacttttttg

SEQ ID NO: 1510 - DNA, 58 bp, Artificial Sequence
  Description of Artificial Sequence: Synthetic oligonucleotide
ccggtcaactgcaagtcaatctgttctcgagaacagattgacttgcagttgatttttg

SEQ ID NO: 1511 - DNA, 58 bp, Artificial Sequence
  Description of Artificial Sequence: Synthetic oligonucleotide
ccgggacagacatgacttcagatttctcgagaaatctgaagtcatgtctgtctttttg

SEQ ID NO: 1512 - DNA, 58 bp, Artificial Sequence
  Description of Artificial Sequence: Synthetic oligonucleotide
ccggctgtcctccatgaggtgattcctcgaggaatcacctcatggaggacagtttttg

SEQ ID NO: 1513 - DNA, 58 bp, Artificial Sequence
  Description of Artificial Sequence: Synthetic oligonucleotide
ccggaggcttctagacaaactctatctcgagatagagtttgtctagaagccttttttg

SEQ ID NO: 1514 - DNA, 58 bp, Artificial Sequence
  Description of Artificial Sequence: Synthetic oligonucleotide
ccggtaactatctatagggcttaaactcgagtttaagccctatagatagttatttttg

SEQ ID NO: 1515 - DNA, 58 bp, Artificial Sequence
  Description of Artificial Sequence: Synthetic oligonucleotide
ccggccaggaggagtttgatgataactcgagttatcatcaaactcctcctggtttttg

SEQ ID NO: 1516 - DNA, 58 bp, Artificial Sequence
  Description of Artificial Sequence: Synthetic oligonucleotide
ccgggacctggtacaacacggaaatctcgagatttccgtgttgtaccaggtctttttg

SEQ ID NO: 1517 - DNA, 58 bp, Artificial Sequence
  Description of Artificial Sequence: Synthetic oligonucleotide
ccgggccaagattcaggaaattattctcgagaataatttcctgaatcttggctttttg

SEQ ID NO: 1518 - DNA, 58 bp, Artificial Sequence
  Description of Artificial Sequence: Synthetic oligonucleotide
ccgggctctcccgtttgtcatttatctcgagataaatgacaaacgggagagctttttg

SEQ ID NO: 1519 - DNA, 58 bp, Artificial Sequence
  Description of Artificial Sequence: Synthetic oligonucleotide
ccggatgaactgtgtcaagtataagctcgagcttatacttgacacagttcattttttg

SEQ ID NO: 1520 - DNA, 58 bp, Artificial Sequence
  Description of Artificial Sequence: Synthetic oligonucleotide
ccgggagtggaaatttcacctatatctcgagatataggtgaaatttccactctttttg

SEQ ID NO: 1521 - DNA, 58 bp, Artificial Sequence
  Description of Artificial Sequence: Synthetic oligonucleotide
ccggtgtatatcagcctcgtgtttgctcgagcaaacacgaggctgatatacatttttg

SEQ ID NO: 1522 - DNA, 58 bp, Artificial Sequence
  Description of Artificial Sequence: Synthetic oligonucleotide
ccgggcaaataccacaagatcatttctcgagaaatgatcttgtggtatttgctttttg

SEQ ID NO: 1523 - DNA, 58 bp, Artificial Sequence
  Description of Artificial Sequence: Synthetic oligonucleotide
ccggattgaatgggaggcttgaatactcgagtattcaagcctcccattcaattttttg

SEQ ID NO: 1524 - DNA, 58 bp, Artificial Sequence
  Description of Artificial Sequence: Synthetic oligonucleotide
ccggcctacaaagaagcagcaatttctcgagaaattgctgcttctttgtaggtttttg

SEQ ID NO: 1525 - DNA, 58 bp, Artificial Sequence
  Description of Artificial Sequence: Synthetic oligonucleotide
ccggctaatgtctatcatcagataactcgagttatctgatgatagacattagtttttg

SEQ ID NO: 1526 - DNA, 58 bp, Artificial Sequence
  Description of Artificial Sequence: Synthetic oligonucleotide
ccggggtagtgataaccttagattactcgagtaatctaaggttatcactacctttttg

SEQ ID NO: 1527 - DNA, 58 bp, Artificial Sequence
  Description of Artificial Sequence: Synthetic oligonucleotide
ccggagcctcttcagggcaaatattctcgagaatatttgccctgaagaggcttttttg

SEQ ID NO: 1528 - DNA, 58 bp, Artificial Sequence
  Description of Artificial Sequence: Synthetic oligonucleotide
ccggcatagagtggtaatacaatttctcgagaaattgtattaccactctatgtttttg

SEQ ID NO: 1529 - DNA, 58 bp, Artificial Sequence
  Description of Artificial Sequence: Synthetic oligonucleotide
ccggggttgtcctgcctgcaatattctcgagaatattgcaggcaggacaacctttttg

SEQ ID NO: 1530 - DNA, 58 bp, Artificial Sequence
  Description of Artificial Sequence: Synthetic oligonucleotide
ccggcattcagatgtagcggataatctcgagattatccgctacatctgaatgtttttg

SEQ ID NO: 1531 - DNA, 58 bp, Artificial Sequence
  Description of Artificial Sequence: Synthetic oligonucleotide
ccggtgttactgccaggacccatatctcgagatatgggtcctggcagtaacatttttg

SEQ ID NO: 1532 - DNA, 58 bp, Artificial Sequence
  Description of Artificial Sequence: Synthetic oligonucleotide
ccggacgagcaggaagtcgattatgctcgagcataatcgacttcctgctcgttttttg

SEQ ID NO: 1533 - DNA, 58 bp, Artificial Sequence
  Description of Artificial Sequence: Synthetic oligonucleotide
ccggcatgaaccctatcgtatattgctcgagcaatatacgatagggttcatgtttttg

SEQ ID NO: 1534 - DNA, 58 bp, Artificial Sequence
  Description of Artificial Sequence: Synthetic oligonucleotide
ccggcggaagtgagatccagtataactcgagttatactggatctcacttccgtttttg

SEQ ID NO: 1535 - DNA, 58 bp, Artificial Sequence
  Description of Artificial Sequence: Synthetic oligonucleotide
ccgggagattgtggctacgcaaatgctcgagcatttgcgtagccacaatctctttttg

SEQ ID NO: 1536 - DNA, 58 bp, Artificial Sequence
  Description of Artificial Sequence: Synthetic oligonucleotide
ccggctgttcagattcaagattattctcgagaataatcttgaatctgaacagtttttg

SEQ ID NO: 1537 - DNA, 58 bp, Artificial Sequence
  Description of Artificial Sequence: Synthetic oligonucleotide
ccggtcagccaacacaccttcaaatctcgagatttgaaggtgtgttggctgatttttg

SEQ ID NO: 1538 - DNA, 58 bp, Artificial Sequence
  Description of Artificial Sequence: Synthetic oligonucleotide
ccggctcacgcgagacctcaaatatctcgagatatttgaggtctcgcgtgagtttttg

SEQ ID NO: 1539 - DNA, 58 bp, Artificial Sequence
  Description of Artificial Sequence: Synthetic oligonucleotide
ccgggccacattggcaggttcaaatctcgagatttgaacctgccaatgtggctttttg

SEQ ID NO: 1540 - DNA, 58 bp, Artificial Sequence
  Description of Artificial Sequence: Synthetic oligonucleotide
ccgggagttgcagctctcctgtcttctcgagaagacaggagagctgcaactctttttg

SEQ ID NO: 1541 - DNA, 58 bp, Artificial Sequence
  Description of Artificial Sequence: Synthetic oligonucleotide
ccggagggccaaagatgccttagaactcgagttctaaggcatctttggcccttttttg

SEQ ID NO: 1542 - DNA, 58 bp, Artificial Sequence
  Description of Artificial Sequence: Synthetic oligonucleotide
ccgggcctttaagagggccaaagatctcgagatctttggccctcttaaaggctttttg

SEQ ID NO: 1543 - DNA, 58 bp, Artificial Sequence
  Description of Artificial Sequence: Synthetic oligonucleotide
ccggtgccacatagcccagttcaagctcgagcttgaactgggctatgtggcatttttg

SEQ ID NO: 1544 - DNA, 58 bp, Artificial Sequence
  Description of Artificial Sequence: Synthetic oligonucleotide
ccggagactcttatttcggctttaactcgagttaaagccgaaataagagtcttttttg

SEQ ID NO: 1545 - DNA, 58 bp, Artificial Sequence
  Description of Artificial Sequence: Synthetic oligonucleotide
ccggtcagtccctaagatgttatttctcgagaaataacatcttagggactgatttttg

SEQ ID NO: 1546 - DNA, 58 bp, Artificial Sequence
  Description of Artificial Sequence: Synthetic oligonucleotide
ccggcggtatattaagccagtatatctcgagatatactggcttaatataccgtttttg

SEQ ID NO: 1547 - DNA, 58 bp, Artificial Sequence
  Description of Artificial Sequence: Synthetic oligonucleotide
ccggagcttctctgtgaacgatttactcgagtaaatcgttcacagagaagcttttttg

SEQ ID NO: 1548 - DNA, 58 bp, Artificial Sequence
  Description of Artificial Sequence: Synthetic oligonucleotide
ccgggcaggtgaagaatgcctttaactcgagttaaaggcattcttcacctgctttttg

SEQ ID NO: 1549 - DNA, 58 bp, Artificial Sequence
  Description of Artificial Sequence: Synthetic oligonucleotide
ccgggctggacaacttgttgttaaactcgagtttaacaacaagttgtccagctttttg

SEQ ID NO: 1550 - DNA, 58 bp, Artificial Sequence
  Description of Artificial Sequence: Synthetic oligonucleotide
ccggtctgtcgcttcccgaagtaacctcgaggttacttcgggaagcgacagatttttg

SEQ ID NO: 1551 - DNA, 58 bp, Artificial Sequence
  Description of Artificial Sequence: Synthetic oligonucleotide
ccgggaaacaggatcctctagaaatctcgagatttctagaggatcctgtttctttttg

SEQ ID NO: 1552 - DNA, 58 bp, Artificial Sequence
  Description of Artificial Sequence: Synthetic oligonucleotide
ccgggaactctttcctgtatcataactcgagttatgatacaggaaagagttctttttg

SEQ ID NO: 1553 - DNA, 58 bp, Artificial Sequence
  Description of Artificial Sequence: Synthetic oligonucleotide
ccggatatccacttgagggcgatttctcgagaaatcgccctcaagtggatattttttg

SEQ ID NO: 1554 - DNA, 58 bp, Artificial Sequence
  Description of Artificial Sequence: Synthetic oligonucleotide
ccggccttccaaagccagatcttatctcgagataagatctggctttggaaggtttttg

SEQ ID NO: 1555 - DNA, 58 bp, Artificial Sequence
  Description of Artificial Sequence: Synthetic oligonucleotide
ccggtgcacagctgagggacaaattctcgagaatttgtccctcagctgtgcatttttg

SEQ ID NO: 1556 - DNA, 58 bp, Artificial Sequence
  Description of Artificial Sequence: Synthetic oligonucleotide
ccggcggcagattccacctataattctcgagaattataggtggaatctgccgtttttg

SEQ ID NO: 1557 - DNA, 58 bp, Artificial Sequence
  Description of Artificial Sequence: Synthetic oligonucleotide
ccggtcggcagattccacctataatctcgagattataggtggaatctgccgatttttg

SEQ ID NO: 1558 - DNA, 58 bp, Artificial Sequence
  Description of Artificial Sequence: Synthetic oligonucleotide
ccggtggagccagtaccggattaatctcgagattaatccggtactggctccatttttg

SEQ ID NO: 1559 - DNA, 58 bp, Artificial Sequence
  Description of Artificial Sequence: Synthetic oligonucleotide
ccggtgatacctctgatcaagtattctcgagaatacttgatcagaggtatcatttttg

SEQ ID NO: 1560 - DNA, 58 bp, Artificial Sequence
  Description of Artificial Sequence: Synthetic oligonucleotide
ccggcctgtgccttagtagtatttactcgagtaaatactactaaggcacaggtttttg

SEQ ID NO: 1561 - DNA, 58 bp, Artificial Sequence
  Description of Artificial Sequence: Synthetic oligonucleotide
ccggcctgtttaccattggaattaactcgagttaattccaatggtaaacaggtttttg

SEQ ID NO: 1562 - DNA, 58 bp, Artificial Sequence
  Description of Artificial Sequence: Synthetic oligonucleotide
ccgggaatttggtccactgatatttctcgagaaatatcagtggaccaaattctttttg

SEQ ID NO: 1563 - DNA, 58 bp, Artificial Sequence
  Description of Artificial Sequence: Synthetic oligonucleotide
ccggccatgggccttcatgctatttctcgagaaatagcatgaaggcccatggtttttg

SEQ ID NO: 1564 - DNA, 58 bp, Artificial Sequence
  Description of Artificial Sequence: Synthetic oligonucleotide
ccggttagatgctaaatgctcattgctcgagcaatgagcatttagcatctaatttttg

SEQ ID NO: 1565 - DNA, 58 bp, Artificial Sequence
  Description of Artificial Sequence: Synthetic oligonucleotide
ccggcagctctacaactcagttaaactcgagtttaactgagttgtagagctgtttttg

SEQ ID NO: 1566 - DNA, 58 bp, Artificial Sequence
  Description of Artificial Sequence: Synthetic oligonucleotide
ccgggtcatctcctcgaaccaatttctcgagaaattggttcgaggagatgactttttg

SEQ ID NO: 1567 - DNA, 58 bp, Artificial Sequence
  Description of Artificial Sequence: Synthetic oligonucleotide
ccggccaacgggaccaccatgtattctcgagaatacatggtggtcccgttggtttttg

SEQ ID NO: 1568 - DNA, 58 bp, Artificial Sequence
  Description of Artificial Sequence: Synthetic oligonucleotide
ccggacttcgaaagcatcattatttctcgagaaataatgatgctttcgaagttttttg

SEQ ID NO: 1569 - DNA, 58 bp, Artificial Sequence
  Description of Artificial Sequence: Synthetic oligonucleotide
ccggattgaagttgcagattcatttctcgagaaatgaatctgcaacttcaattttttg

SEQ ID NO: 1570 - DNA, 58 bp, Artificial Sequence
  Description of Artificial Sequence: Synthetic oligonucleotide
ccggcctgctcttacatttaaagaactcgagttctttaaatgtaagagcaggtttttg

SEQ ID NO: 1571 - DNA, 58 bp, Artificial Sequence
  Description of Artificial Sequence: Synthetic oligonucleotide
ccgggaagatcttattcaatctatgctcgagcatagattgaataagatcttctttttg

SEQ ID NO: 1572 - DNA, 58 bp, Artificial Sequence
  Description of Artificial Sequence: Synthetic oligonucleotide
ccggtaagggtgatagtcaaattatctcgagataatttgactatcacccttatttttg

SEQ ID NO: 1573 - DNA, 58 bp, Artificial Sequence
  Description of Artificial Sequence: Synthetic oligonucleotide
ccggcactctgctgcttagacataactcgagttatgtctaagcagcagagtgtttttg

SEQ ID NO: 1574 - DNA, 58 bp, Artificial Sequence
  Description of Artificial Sequence: Synthetic oligonucleotide
ccggtgggaccacgtgagatcattcctcgaggaatgatctcacgtggtcccatttttg

SEQ ID NO: 1575 - DNA, 58 bp, Artificial Sequence
  Description of Artificial Sequence: Synthetic oligonucleotide
ccgggttctggatgaagcaacattactcgagtaatgttgcttcatccagaactttttg

SEQ ID NO: 1576 - DNA, 58 bp, Artificial Sequence
  Description of Artificial Sequence: Synthetic oligonucleotide
ccggcccaaacagtgacatttatttctcgagaaataaatgtcactgtttgggtttttg

SEQ ID NO: 1577 - DNA, 58 bp, Artificial Sequence
  Description of Artificial Sequence: Synthetic oligonucleotide
ccggatcagttctgcctaggtaaatctcgagatttacctaggcagaactgattttttg

SEQ ID NO: 1578 - DNA, 58 bp, Artificial Sequence
  Description of Artificial Sequence: Synthetic oligonucleotide
ccgggagctatttaaggatctatttctcgagaaatagatccttaaatagctctttttg

SEQ ID NO: 1579 - DNA, 58 bp, Artificial Sequence
  Description of Artificial Sequence: Synthetic oligonucleotide
ccggggtcaacctgaacatccataactcgagttatggatgttcaggttgacctttttg

SEQ ID NO: 1580 - DNA, 58 bp, Artificial Sequence
  Description of Artificial Sequence: Synthetic oligonucleotide
ccggtatgcccgcatggaggagtatctcgagatactcctccatgcgggcatatttttg

SEQ ID NO: 1581 - DNA, 58 bp, Artificial Sequence
  Description of Artificial Sequence: Synthetic oligonucleotide
ccgggtgtcacggatgaaaccgtatctcgagatacggtttcatccgtgacactttttg

SEQ ID NO: 1582 - DNA, 58 bp, Artificial Sequence
  Description of Artificial Sequence: Synthetic oligonucleotide
ccgggcagctgtggatgtccaacaactcgagttgttggacatccacagctgctttttg

SEQ ID NO: 1583 - DNA, 58 bp, Artificial Sequence
  Description of Artificial Sequence: Synthetic oligonucleotide
ccgggcacctcttccagcccttaaactcgagtttaagggctggaagaggtgctttttg

SEQ ID NO: 1584 - DNA, 58 bp, Artificial Sequence
  Description of Artificial Sequence: Synthetic oligonucleotide
ccggctttgccttccacaccgagttctcgagaactcggtgtggaaggcaaagtttttg

SEQ ID NO: 1585 - DNA, 58 bp, Artificial Sequence
  Description of Artificial Sequence: Synthetic oligonucleotide
ccggatctccagcctcagtagttggctcgagccaactactgaggctggagattttttg

SEQ ID NO: 1586 - DNA, 58 bp, Artificial Sequence
  Description of Artificial Sequence: Synthetic oligonucleotide
ccggagagctactctgttacatttcctcgaggaaatgtaacagagtagctcttttttg

SEQ ID NO: 1587 - DNA, 58 bp, Artificial Sequence
  Description of Artificial Sequence: Synthetic oligonucleotide
ccggcaaagagatagggacgcatatctcgagatatgcgtccctatctctttgtttttg

SEQ ID NO: 1588 - DNA, 58 bp, Artificial Sequence
  Description of Artificial Sequence: Synthetic oligonucleotide
ccggagacagcatcaactccagcatctcgagatgctggagttgatgctgtcttttttg

SEQ ID NO: 1589 - DNA, 58 bp, Artificial Sequence
  Description of Artificial Sequence: Synthetic oligonucleotide
ccggtcatccaccatgtgcagtaagctcgagcttactgcacatggtggatgatttttg

SEQ ID NO: 1590 - DNA, 58 bp, Artificial Sequence
  Description of Artificial Sequence: Synthetic oligonucleotide
ccgggtacttgctgctgtcgatattctcgagaatatcgacagcagcaagtactttttg

SEQ ID NO: 1591 - DNA, 58 bp, Artificial Sequence
  Description of Artificial Sequence: Synthetic oligonucleotide
ccggcgtttccatgtcacgtaacatctcgagatgttacgtgacatggaaacgtttttg

SEQ ID NO: 1592 - DNA, 58 bp, Artificial Sequence
  Description of Artificial Sequence: Synthetic oligonucleotide
ccggcccggaccatatttattataactcgagttataataaatatggtccgggtttttg

SEQ ID NO: 1593 - DNA, 58 bp, Artificial Sequence
  Description of Artificial Sequence: Synthetic oligonucleotide
ccggtgattctgactgtagagataactcgagttatctctacagtcagaatcatttttg

SEQ ID NO: 1594 - DNA, 58 bp, Artificial Sequence
  Description of Artificial Sequence: Synthetic oligonucleotide
ccggtggcaagcttgaatctaaattctcgagaatttagattcaagcttgccatttttg

SEQ ID NO: 1595 - DNA, 58 bp, Artificial Sequence
  Description of Artificial Sequence: Synthetic oligonucleotide
ccggggtcccttctctcaccaaattctcgagaatttggtgagagaagggacctttttg

SEQ ID NO: 1596 - DNA, 58 bp, Artificial Sequence
  Description of Artificial Sequence: Synthetic oligonucleotide
ccggtcccatgtctctgctcatttactcgagtaaatgagcagagacatgggatttttg

SEQ ID NO: 1597 - DNA, 58 bp, Artificial Sequence
  Description of Artificial Sequence: Synthetic oligonucleotide
ccggctgggcaatggttccttcattctcgagaatgaaggaaccattgcccagtttttg

SEQ ID NO: 1598 - DNA, 58 bp, Artificial Sequence
  Description of Artificial Sequence: Synthetic oligonucleotide
ccgggtccacgctgctgccattaaactcgagtttaatggcagcagcgtggactttttg

SEQ ID NO: 1599 - DNA, 58 bp, Artificial Sequence
  Description of Artificial Sequence: Synthetic oligonucleotide
ccggtccacagacatgcaccatatactcgagtatatggtgcatgtctgtggatttttg

SEQ ID NO: 1600 - DNA, 58 bp, Artificial Sequence
  Description of Artificial Sequence: Synthetic oligonucleotide
ccggtgatgacaaggaacctgtatactcgagtatacaggttccttgtcatcatttttg

SEQ ID NO: 1601 - DNA, 58 bp, Artificial Sequence
  Description of Artificial Sequence: Synthetic oligonucleotide
ccgggtggaaccaacactaacatatctcgagatatgttagtgttggttccactttttg

SEQ ID NO: 1602 - DNA, 58 bp, Artificial Sequence
  Description of Artificial Sequence: Synthetic oligonucleotide
ccgggccctcaatcaaagtataattctcgagaattatactttgattgagggctttttg

SEQ ID NO: 1603 - DNA, 58 bp, Artificial Sequence
  Description of Artificial Sequence: Synthetic oligonucleotide
ccggtattacagatgggcaaattaactcgagttaatttgcccatctgtaatatttttg

SEQ ID NO: 1604 - DNA, 58 bp, Artificial Sequence
  Description of Artificial Sequence: Synthetic oligonucleotide
ccggatcaataacaagctggaatttctcgagaaattccagcttgttattgattttttg

SEQ ID NO: 1605 - DNA, 58 bp, Artificial Sequence
  Description of Artificial Sequence: Synthetic oligonucleotide
ccggagcaaccgcttccctatttatctcgagataaatagggaagcggttgcttttttg

SEQ ID NO: 1606 - DNA, 58 bp, Artificial Sequence
  Description of Artificial Sequence: Synthetic oligonucleotide
ccggctgacttcaccatgcaatttgctcgagcaaattgcatggtgaagtcagtttttg

SEQ ID NO: 1607 - DNA, 58 bp, Artificial Sequence
  Description of Artificial Sequence: Synthetic oligonucleotide
ccggtccttgtgggctcagtttaatctcgagattaaactgagcccacaaggatttttg

SEQ ID NO: 1608 - DNA, 58 bp, Artificial Sequence
  Description of Artificial Sequence: Synthetic oligonucleotide
ccggggtctatggtaggcagaataactcgagttattctgcctaccatagacctttttg

SEQ ID NO: 1609 - DNA, 58 bp, Artificial Sequence
  Description of Artificial Sequence: Synthetic oligonucleotide
ccggtgcagaccagaaggctctatactcgagtatagagccttctggtctgcatttttg

SEQ ID NO: 1610 - DNA, 58 bp, Artificial Sequence
  Description of Artificial Sequence: Synthetic oligonucleotide
ccgggccaagaatacacatggtatactcgagtataccatgtgtattcttggctttttg

SEQ ID NO: 1611 - DNA, 58 bp, Artificial Sequence
  Description of Artificial Sequence: Synthetic oligonucleotide
ccggataatgcacaagccatatttactcgagtaaatatggcttgtgcattattttttg

SEQ ID NO: 1612 - DNA, 58 bp, Artificial Sequence
  Description of Artificial Sequence: Synthetic oligonucleotide
ccggtggtatagatgcagcatatatctcgagatatatgctgcatctataccatttttg

SEQ ID NO: 1613 - DNA, 58 bp, Artificial Sequence
  Description of Artificial Sequence: Synthetic oligonucleotide
ccggcaatcccgtgtaaggtgtttcctcgaggaaacaccttacacgggattgtttttg

SEQ ID NO: 1614 - DNA, 58 bp, Artificial Sequence
  Description of Artificial Sequence: Synthetic oligonucleotide
ccgggaccattcctgtgatcatttcctcgaggaaatgatcacaggaatggtctttttg

SEQ ID NO: 1615 - DNA, 58 bp, Artificial Sequence
  Description of Artificial Sequence: Synthetic oligonucleotide
ccggcgttcatctcatacccgcaaactcgagtttgcgggtatgagatgaacgtttttg

SEQ ID NO: 1616 - DNA, 58 bp, Artificial Sequence
  Description of Artificial Sequence: Synthetic oligonucleotide
ccggcaaagcaagcggctgattattctcgagaataatcagccgcttgctttgtttttg

SEQ ID NO: 1617 - DNA, 58 bp, Artificial Sequence
  Description of Artificial Sequence: Synthetic oligonucleotide
ccgggccagcgttctccttcataaactcgagtttatgaaggagaacgctggctttttg

SEQ ID NO: 1618 - DNA, 58 bp, Artificial Sequence
  Description of Artificial Sequence: Synthetic oligonucleotide
ccggtcaagctcctgacggtcattactcgagtaatgaccgtcaggagcttgatttttg

SEQ ID NO: 1619 - DNA, 58 bp, Artificial Sequence
  Description of Artificial Sequence: Synthetic oligonucleotide
ccggttacaccgtggattggtattactcgagtaataccaatccacggtgtaatttttg

SEQ ID NO: 1620 - DNA, 58 bp, Artificial Sequence
  Description of Artificial Sequence: Synthetic oligonucleotide
ccggagttgctgattctggtatttactcgagtaaataccagaatcagcaacttttttg

SEQ ID NO: 1621 - DNA, 58 bp, Artificial Sequence
  Description of Artificial Sequence: Synthetic oligonucleotide
ccggcgtgaaggaagaggatttattctcgagaataaatcctcttccttcacgtttttg

SEQ ID NO: 1622 - DNA, 58 bp, Artificial Sequence
  Description of Artificial Sequence: Synthetic oligonucleotide
ccgggcaaggaccaaatgtcaatttctcgagaaattgacatttggtccttgctttttg

SEQ ID NO: 1623 - DNA, 58 bp, Artificial Sequence
  Description of Artificial Sequence: Synthetic oligonucleotide
ccggcgtcatggtcaccaaattctactcgagtagaatttggtgaccatgacgtttttg

SEQ ID NO: 1624 - DNA, 58 bp, Artificial Sequence
  Description of Artificial Sequence: Synthetic oligonucleotide
ccggctgcctccagaatggtctttcctcgaggaaagaccattctggaggcagtttttg

SEQ ID NO: 1625 - DNA, 58 bp, Artificial Sequence
  Description of Artificial Sequence: Synthetic oligonucleotide
ccgggctacctattgtaactattatctcgagataatagttacaataggtagctttttg

SEQ ID NO: 1626 - DNA, 58 bp, Artificial Sequence
  Description of Artificial Sequence: Synthetic oligonucleotide
ccggcagctacaactggagcatttactcgagtaaatgctccagttgtagctgtttttg

SEQ ID NO: 1627 - DNA, 58 bp, Artificial Sequence
  Description of Artificial Sequence: Synthetic oligonucleotide
ccggtgctggatttacagatgatttctcgagaaatcatctgtaaatccagcatttttg

SEQ ID NO: 1628 - DNA, 58 bp, Artificial Sequence
  Description of Artificial Sequence: Synthetic oligonucleotide
ccggctgatgctctgtgagatatttctcgagaaatatctcacagagcatcagtttttg

SEQ ID NO: 1629 - DNA, 58 bp, Artificial Sequence
  Description of Artificial Sequence: Synthetic oligonucleotide
ccggtggtcacagtgtatcttatttctcgagaaataagatacactgtgaccatttttg

SEQ ID NO: 1630 - DNA, 58 bp, Artificial Sequence
  Description of Artificial Sequence: Synthetic oligonucleotide
ccggggactgaagacactcaatttgctcgagcaaattgagtgtcttcagtcctttttg

SEQ ID NO: 1631 - DNA, 58 bp, Artificial Sequence
  Description of Artificial Sequence: Synthetic oligonucleotide
ccggccagtattatgccaaagttaactcgagttaactttggcataatactggtttttg

SEQ ID NO: 1632 - DNA, 58 bp, Artificial Sequence
  Description of Artificial Sequence: Synthetic oligonucleotide
ccgggagggtcttcaaggagttaaactcgagtttaactccttgaagaccctctttttg

SEQ ID NO: 1633 - DNA, 58 bp, Artificial Sequence
  Description of Artificial Sequence: Synthetic oligonucleotide
ccgggcttcgcatttgatggaaattctcgagaatttccatcaaatgcgaagctttttg

SEQ ID NO: 1634 - DNA, 58 bp, Artificial Sequence
  Description of Artificial Sequence: Synthetic oligonucleotide
ccggcagtgtactattctgtcgaatctcgagattcgacagaatagtacactgtttttg

SEQ ID NO: 1635 - DNA, 58 bp, Artificial Sequence
  Description of Artificial Sequence: Synthetic oligonucleotide
ccggccagaataatccttgagagaactcgagttctctcaaggattattctggtttttg

SEQ ID NO: 1636 - DNA, 58 bp, Artificial Sequence
  Description of Artificial Sequence: Synthetic oligonucleotide
ccggctctgtactctcaaccaacatctcgagatgttggttgagagtacagagtttttg

SEQ ID NO: 1637 - DNA, 58 bp, Artificial Sequence
  Description of Artificial Sequence: Synthetic oligonucleotide
ccggaggaaaccaccttccacaaatctcgagatttgtggaaggtggtttccttttttg

SEQ ID NO: 1638 - DNA, 58 bp, Artificial Sequence
  Description of Artificial Sequence: Synthetic oligonucleotide
ccggatgacttggtccctgaatttcctcgaggaaattcagggaccaagtcattttttg

SEQ ID NO: 1639 - DNA, 58 bp, Artificial Sequence
  Description of Artificial Sequence: Synthetic oligonucleotide
ccggctttcagaaggcccaactaaactcgagtttagttgggccttctgaaagtttttg

SEQ ID NO: 1640 - DNA, 58 bp, Artificial Sequence
  Description of Artificial Sequence: Synthetic oligonucleotide
ccggaggctaagcacatgtcatattctcgagaatatgacatgtgcttagccttttttg

SEQ ID NO: 1641 - DNA, 58 bp, Artificial Sequence
  Description of Artificial Sequence: Synthetic oligonucleotide
ccgggtttccataatcagtactttactcgagtaaagtactgattatggaaactttttg

SEQ ID NO: 1642 - DNA, 58 bp, Artificial Sequence
  Description of Artificial Sequence: Synthetic oligonucleotide
ccggagactttctaagcatagatatctcgagatatctatgcttagaaagtcttttttg

SEQ ID NO: 1643 - DNA, 58 bp, Artificial Sequence
  Description of Artificial Sequence: Synthetic oligonucleotide
ccggggacactttctagtcctaaacctcgaggtttaggactagaaagtgtcctttttg

SEQ ID NO: 1644 - DNA, 58 bp, Artificial Sequence
  Description of Artificial Sequence: Synthetic oligonucleotide
ccggagggacaccacagtacctaaactcgagtttaggtactgtggtgtcccttttttg

SEQ ID NO: 1645 - DNA, 58 bp, Artificial Sequence
  Description of Artificial Sequence: Synthetic oligonucleotide
ccggctgtccgagatcacctacttactcgagtaagtaggtgatctcggacagtttttg

SEQ ID NO: 1646 - DNA, 58 bp, Artificial Sequence
  Description of Artificial Sequence: Synthetic oligonucleotide
ccggagacatacaggaaccttattactcgagtaataaggttcctgtatgtcttttttg

SEQ ID NO: 1647 - DNA, 58 bp, Artificial Sequence
  Description of Artificial Sequence: Synthetic oligonucleotide
ccggctcgtgtttgaaggatcttatctcgagataagatccttcaaacacgagtttttg

SEQ ID NO: 1648 - DNA, 58 bp, Artificial Sequence
  Description of Artificial Sequence: Synthetic oligonucleotide
ccggtgctccaaatttaccatatagctcgagctatatggtaaatttggagcatttttg

SEQ ID NO: 1649 - DNA, 58 bp, Artificial Sequence
  Description of Artificial Sequence: Synthetic oligonucleotide
ccggagctgctaggatcggatatttctcgagaaatatccgatcctagcagcttttttg

SEQ ID NO: 1650 - DNA, 58 bp, Artificial Sequence
  Description of Artificial Sequence: Synthetic oligonucleotide
ccggctgtgagccaacaggttaattctcgagaattaacctgttggctcacagtttttg

SEQ ID NO: 1651 - DNA, 58 bp, Artificial Sequence
  Description of Artificial Sequence: Synthetic oligonucleotide
ccggggatccaccagggtctgatttctcgagaaatcagaccctggtggatcctttttg

SEQ ID NO: 1652 - DNA, 58 bp, Artificial Sequence
  Description of Artificial Sequence: Synthetic oligonucleotide
ccggctttctttgattgggatatttctcgagaaatatcccaatcaaagaaagtttttg

SEQ ID NO: 1653 - DNA, 58 bp, Artificial Sequence
  Description of Artificial Sequence: Synthetic oligonucleotide
ccggtatctcacctcaagctatattctcgagaatatagcttgaggtgagatatttttg

SEQ ID NO: 1654 - DNA, 58 bp, Artificial Sequence
  Description of Artificial Sequence: Synthetic oligonucleotide
ccggcgacaatactacagttgtatactcgagtatacaactgtagtattgtcgtttttg

SEQ ID NO: 1655 - DNA, 58 bp, Artificial Sequence
  Description of Artificial Sequence: Synthetic oligonucleotide
ccggcacaggcggtttctgctattcctcgaggaatagcagaaaccgcctgtgtttttg

SEQ ID NO: 1656 - DNA, 58 bp, Artificial Sequence
  Description of Artificial Sequence: Synthetic oligonucleotide
ccgggtcaggactctgaagtcattcctcgaggaatgacttcagagtcctgactttttg

SEQ ID NO: 1657 - DNA, 58 bp, Artificial Sequence
  Description of Artificial Sequence: Synthetic oligonucleotide
ccggtcggatgctgagagctgttacctcgaggtaacagctctcagcatccgatttttg

SEQ ID NO: 1658 - DNA, 58 bp, Artificial Sequence
  Description of Artificial Sequence: Synthetic oligonucleotide
ccggacaggcactttctagatatttctcgagaaatatctagaaagtgcctgttttttg

SEQ ID NO: 1659 - DNA, 58 bp, Artificial Sequence
  Description of Artificial Sequence: Synthetic oligonucleotide
ccggccacaaccagactgtcttctactcgagtagaagacagtctggttgtggtttttg

SEQ ID NO: 1660 - DNA, 58 bp, Artificial Sequence
  Description of Artificial Sequence: Synthetic oligonucleotide
ccggtcctgtagggccagtgaagatctcgagatcttcactggccctacaggatttttg

SEQ ID NO: 1661 - DNA, 58 bp, Artificial Sequence
  Description of Artificial Sequence: Synthetic oligonucleotide
ccggagctgttgacgctctctatatctcgagatatagagagcgtcaacagcttttttg

SEQ ID NO: 1662 - DNA, 58 bp, Artificial Sequence
  Description of Artificial Sequence: Synthetic oligonucleotide
ccggagtacattgtgtcaacttaatctcgagattaagttgacacaatgtacttttttg

SEQ ID NO: 1663 - DNA, 58 bp, Artificial Sequence
  Description of Artificial Sequence: Synthetic oligonucleotide
ccggcgattccagaagaccgcataactcgagttatgcggtcttctggaatcgtttttg

SEQ ID NO: 1664 - DNA, 58 bp, Artificial Sequence
  Description of Artificial Sequence: Synthetic oligonucleotide
ccggactccttggagctcgtcttatctcgagataagacgagctccaaggagttttttg

SEQ ID NO: 1665 - DNA, 58 bp, Artificial Sequence
  Description of Artificial Sequence: Synthetic oligonucleotide
ccggactttaggactggagtcttggctcgagccaagactccagtcctaaagttttttg

SEQ ID NO: 1666 - DNA, 58 bp, Artificial Sequence
  Description of Artificial Sequence: Synthetic oligonucleotide
ccggcatcatcagccttggacaaggctcgagccttgtccaaggctgatgatgtttttg

SEQ ID NO: 1667 - DNA, 58 bp, Artificial Sequence
  Description of Artificial Sequence: Synthetic oligonucleotide
ccggcctcgtcacaacaacagatttctcgagaaatctgttgttgtgacgaggtttttg

SEQ ID NO: 1668 - DNA, 58 bp, Artificial Sequence
  Description of Artificial Sequence: Synthetic oligonucleotide
ccggaccctatacaactggacattgctcgagcaatgtccagttgtatagggttttttg

SEQ ID NO: 1669 - DNA, 58 bp, Artificial Sequence
  Description of Artificial Sequence: Synthetic oligonucleotide
ccggactcggaacacaacgaaacaactcgagttgtttcgttgtgttccgagttttttg

SEQ ID NO: 1670 - DNA, 58 bp, Artificial Sequence
  Description of Artificial Sequence: Synthetic oligonucleotide
ccggagtcccagacctggtggatttctcgagaaatccaccaggtctgggacttttttg

SEQ ID NO: 1671 - DNA, 58 bp, Artificial Sequence
  Description of Artificial Sequence: Synthetic oligonucleotide
ccgggacccacagatgcaacataagctcgagcttatgttgcatctgtgggtctttttg

SEQ ID NO: 1672 - DNA, 58 bp, Artificial Sequence
  Description of Artificial Sequence: Synthetic oligonucleotide
ccggccagacacccagtatgagtttctcgagaaactcatactgggtgtctggtttttg

SEQ ID NO: 1673 - DNA, 58 bp, Artificial Sequence
  Description of Artificial Sequence: Synthetic oligonucleotide
ccggtcgtgttcggagccgctttaactcgagttaaagcggctccgaacacgatttttg

SEQ ID NO: 1674 - DNA, 58 bp, Artificial Sequence
  Description of Artificial Sequence: Synthetic oligonucleotide
ccggccaacctcactctgcattattctcgagaataatgcagagtgaggttggtttttg

SEQ ID NO: 1675 - DNA, 58 bp, Artificial Sequence
  Description of Artificial Sequence: Synthetic oligonucleotide
ccggttggctccatgggattgattactcgagtaatcaatcccatggagccaatttttg

SEQ ID NO: 1676 - DNA, 58 bp, Artificial Sequence
  Description of Artificial Sequence: Synthetic oligonucleotide
ccggttatcccattgagactatttactcgagtaaatagtctcaatgggataatttttg

SEQ ID NO: 1677 - DNA, 58 bp, Artificial Sequence
  Description of Artificial Sequence: Synthetic oligonucleotide
ccggcggcatcagatgaattgttaactcgagttaacaattcatctgatgccgtttttg

SEQ ID NO: 1678 - DNA, 58 bp, Artificial Sequence
  Description of Artificial Sequence: Synthetic oligonucleotide
ccgggcaattgagagcattcttaaactcgagtttaagaatgctctcaattgctttttg

SEQ ID NO: 1679 - DNA, 58 bp, Artificial Sequence
  Description of Artificial Sequence: Synthetic oligonucleotide
ccgggcatatctcaagacaatcagactcgagtctgattgtcttgagatatgctttttg

SEQ ID NO: 1680 - DNA, 58 bp, Artificial Sequence
  Description of Artificial Sequence: Synthetic oligonucleotide
ccggccaagtgatgatgtacagaaactcgagtttctgtacatcatcacttggtttttg

SEQ ID NO: 1681 - DNA, 58 bp, Artificial Sequence
  Description of Artificial Sequence: Synthetic oligonucleotide
ccggcctgactatttctcaacagttctcgagaactgttgagaaatagtcaggtttttg

SEQ ID NO: 1682 - DNA, 58 bp, Artificial Sequence
  Description of Artificial Sequence: Synthetic oligonucleotide
ccggcatcaaacgaatgattcaaatctcgagatttgaatcattcgtttgatgtttttg

SEQ ID NO: 1683 - DNA, 58 bp, Artificial Sequence
  Description of Artificial Sequence: Synthetic oligonucleotide
ccggcgcctgtttcatctgatttaactcgagttaaatcagatgaaacaggcgtttttg

SEQ ID NO: 1684 - DNA, 58 bp, Artificial Sequence
  Description of Artificial Sequence: Synthetic oligonucleotide
ccggtttcctgtgtctactactatactcgagtatagtagtagacacaggaaatttttg

SEQ ID NO: 1685 - DNA, 58 bp, Artificial Sequence
  Description of Artificial Sequence: Synthetic oligonucleotide
ccggtgtcgccctggcatcttaatactcgagtattaagatgccagggcgacatttttg

SEQ ID NO: 1686 - DNA, 58 bp, Artificial Sequence
  Description of Artificial Sequence: Synthetic oligonucleotide
ccggagagctcactcctctacttgactcgagtcaagtagaggagtgagctcttttttg

SEQ ID NO: 1687 - DNA, 58 bp, Artificial Sequence
  Description of Artificial Sequence: Synthetic oligonucleotide
ccggagagctggaggacgacttcaactcgagttgaagtcgtcctccagctcttttttg

SEQ ID NO: 1688 - DNA, 58 bp, Artificial Sequence
  Description of Artificial Sequence: Synthetic oligonucleotide
ccgggagtgctttgcctttggtatactcgagtataccaaaggcaaagcactctttttg

SEQ ID NO: 1689 - DNA, 58 bp, Artificial Sequence
  Description of Artificial Sequence: Synthetic oligonucleotide
ccgggcactccaactgtgtttcattctcgagaatgaaacacagttggagtgctttttg

SEQ ID NO: 1690 - DNA, 58 bp, Artificial Sequence
  Description of Artificial Sequence: Synthetic oligonucleotide
ccggcctgttactttaggagagaaactcgagtttctctcctaaagtaacaggtttttg

SEQ ID NO: 1691 - DNA, 58 bp, Artificial Sequence
  Description of Artificial Sequence: Synthetic oligonucleotide
ccgggccgacttcagtacatgaaacctcgaggtttcatgtactgaagtcggctttttg

SEQ ID NO: 1692 - DNA, 58 bp, Artificial Sequence
  Description of Artificial Sequence: Synthetic oligonucleotide
ccggcagagccctcattgcagtatgctcgagcatactgcaatgagggctctgtttttg

SEQ ID NO: 1693 - DNA, 58 bp, Artificial Sequence
  Description of Artificial Sequence: Synthetic oligonucleotide
ccggccgtgttgtccctcttgaatgctcgagcattcaagagggacaacacggtttttg

SEQ ID NO: 1694 - DNA, 58 bp, Artificial Sequence
  Description of Artificial Sequence: Synthetic oligonucleotide
ccggctccagtcactattgccttaactcgagttaaggcaatagtgactggagtttttg

SEQ ID NO: 1695 - DNA, 58 bp, Artificial Sequence
  Description of Artificial Sequence: Synthetic oligonucleotide
ccggttcaggaccagacgctcatagctcgagctatgagcgtctggtcctgaatttttg

SEQ ID NO: 1696 - DNA, 58 bp, Artificial Sequence
  Description of Artificial Sequence: Synthetic oligonucleotide
ccggctctgcctgatgtgtgctaaactcgagtttagcacacatcaggcagagtttttg

SEQ ID NO: 1697 - DNA, 58 bp, Artificial Sequence
  Description of Artificial Sequence: Synthetic oligonucleotide
ccggatcctatgctattcgtgattcctcgaggaatcacgaatagcataggattttttg

SEQ ID NO: 1698 - DNA, 58 bp, Artificial Sequence
  Description of Artificial Sequence: Synthetic oligonucleotide
ccggcctgagtggaaattctttaatctcgagattaaagaatttccactcaggtttttg

SEQ ID NO: 1699 - DNA, 58 bp, Artificial Sequence
  Description of Artificial Sequence: Synthetic oligonucleotide
ccggttggactacataacctgtaaactcgagtttacaggttatgtagtccaatttttg

SEQ ID NO: 1700 - DNA, 58 bp, Artificial Sequence
  Description of Artificial Sequence: Synthetic oligonucleotide
ccggtgatatcatccagtctttatactcgagtataaagactggatgatatcatttttg

SEQ ID NO: 1701 - DNA, 58 bp, Artificial Sequence
  Description of Artificial Sequence: Synthetic oligonucleotide
ccggcaggagagctgggtggtataactcgagttataccacccagctctcctgtttttg

SEQ ID NO: 1702 - DNA, 58 bp, Artificial Sequence
  Description of Artificial Sequence: Synthetic oligonucleotide
ccgggggaatccagaatccagaaatctcgagatttctggattctggattccctttttg

SEQ ID NO: 1703 - DNA, 58 bp, Artificial Sequence
  Description of Artificial Sequence: Synthetic oligonucleotide
ccggctcggcattgaaggtgctttactcgagtaaagcaccttcaatgccgagtttttg

SEQ ID NO: 1704 - DNA, 58 bp, Artificial Sequence
  Description of Artificial Sequence: Synthetic oligonucleotide
ccggtggttcccagtttggataaatctcgagatttatccaaactgggaaccatttttg

SEQ ID NO: 1705 - DNA, 58 bp, Artificial Sequence
  Description of Artificial Sequence: Synthetic oligonucleotide
ccgggggaatcattcctgcttaatgctcgagcattaagcaggaatgattccctttttg

SEQ ID NO: 1706 - DNA, 58 bp, Artificial Sequence
  Description of Artificial Sequence: Synthetic oligonucleotide
ccggctctactgtgacaaggataaactcgagtttatccttgtcacagtagagtttttg

SEQ ID NO: 1707 - DNA, 58 bp, Artificial Sequence
  Description of Artificial Sequence: Synthetic oligonucleotide
ccggtgcacctcctgcaattgtaatctcgagattacaattgcaggaggtgcatttttg

SEQ ID NO: 1708 - DNA, 58 bp, Artificial Sequence
  Description of Artificial Sequence: Synthetic oligonucleotide
ccgggttcacacaaagatcttctttctcgagaaagaagatctttgtgtgaactttttg

SEQ ID NO: 1709 - DNA, 58 bp, Artificial Sequence
  Description of Artificial Sequence: Synthetic oligonucleotide
ccggagctgatccgattcctgaaacctcgaggtttcaggaatcggatcagcttttttg

SEQ ID NO: 1710 - DNA, 58 bp, Artificial Sequence
  Description of Artificial Sequence: Synthetic oligonucleotide
ccggccacggacacaagtgcgatatctcgagatatcgcacttgtgtccgtggtttttg

SEQ ID NO: 1711 - DNA, 58 bp, Artificial Sequence
  Description of Artificial Sequence: Synthetic oligonucleotide
ccggtagcatgtgccggcaactttgctcgagcaaagttgccggcacatgctatttttg

SEQ ID NO: 1712 - DNA, 58 bp, Artificial Sequence
  Description of Artificial Sequence: Synthetic oligonucleotide
ccgggcaagagtttcttggtgtaatctcgagattacaccaagaaactcttgctttttg

SEQ ID NO: 1713 - DNA, 58 bp, Artificial Sequence
  Description of Artificial Sequence: Synthetic oligonucleotide
ccgggggtactgtggaaagactattctcgagaatagtctttccacagtaccctttttg

SEQ ID NO: 1714 - DNA, 58 bp, Artificial Sequence
  Description of Artificial Sequence: Synthetic oligonucleotide
ccgggaaagagtcaggccttaatttctcgagaaattaaggcctgactctttctttttg

SEQ ID NO: 1715 - DNA, 58 bp, Artificial Sequence
  Description of Artificial Sequence: Synthetic oligonucleotide
ccggatgagcgttaggacactatttctcgagaaatagtgtcctaacgctcattttttg

SEQ ID NO: 1716 - DNA, 58 bp, Artificial Sequence
  Description of Artificial Sequence: Synthetic oligonucleotide
ccgggagtacctccagaacagatttctcgagaaatctgttctggaggtactctttttg

SEQ ID NO: 1717 - DNA, 58 bp, Artificial Sequence
  Description of Artificial Sequence: Synthetic oligonucleotide
ccggatgtgaagctgagttaatttactcgagtaaattaactcagcttcacattttttg

SEQ ID NO: 1718 - DNA, 58 bp, Artificial Sequence
  Description of Artificial Sequence: Synthetic oligonucleotide
ccgggcaggcacttactactaataactcgagttattagtagtaagtgcctgctttttg

SEQ ID NO: 1719 - DNA, 58 bp, Artificial Sequence
  Description of Artificial Sequence: Synthetic oligonucleotide
ccggtatcgggctgaacggtcaaagctcgagctttgaccgttcagcccgatatttttg

SEQ ID NO: 1720 - DNA, 58 bp, Artificial Sequence
  Description of Artificial Sequence: Synthetic oligonucleotide
ccggctggaccctgtggatgataaactcgagtttatcatccacagggtccagtttttg

SEQ ID NO: 1721 - DNA, 58 bp, Artificial Sequence
  Description of Artificial Sequence: Synthetic oligonucleotide
ccggaccgtgcatcgcacctatttactcgagtaaataggtgcgatgcacggttttttg

SEQ ID NO: 1722 - DNA, 58 bp, Artificial Sequence
  Description of Artificial Sequence: Synthetic oligonucleotide
ccggacttcagcagtacctataaagctcgagctttataggtactgctgaagttttttg

SEQ ID NO: 1723 - DNA, 58 bp, Artificial Sequence
  Description of Artificial Sequence: Synthetic oligonucleotide
ccggcggccagaagatctacaattactcgagtaattgtagatcttctggccgtttttg

SEQ ID NO: 1724 - DNA, 58 bp, Artificial Sequence
  Description of Artificial Sequence: Synthetic oligonucleotide
ccgggctcgcaagttgaggcaatttctcgagaaattgcctcaacttgcgagctttttg

SEQ ID NO: 1725 - DNA, 58 bp, Artificial Sequence
  Description of Artificial Sequence: Synthetic oligonucleotide
ccgggctcactatgaatctattatactcgagtataatagattcatagtgagctttttg

SEQ ID NO: 1726 - DNA, 58 bp, Artificial Sequence
  Description of Artificial Sequence: Synthetic oligonucleotide
ccgggtgtttcctaaagagactattctcgagaatagtctctttaggaaacactttttg

SEQ ID NO: 1727 - DNA, 58 bp, Artificial Sequence
  Description of Artificial Sequence: Synthetic oligonucleotide
ccggaccaccatgcaaacaagatacctcgaggtatcttgtttgcatggtggttttttg

SEQ ID NO: 1728 - DNA, 58 bp, Artificial Sequence
  Description of Artificial Sequence: Synthetic oligonucleotide
ccgggaacaacaagtgtccatatttctcgagaaatatggacacttgttgttctttttg

SEQ ID NO: 1729 - DNA, 58 bp, Artificial Sequence
  Description of Artificial Sequence: Synthetic oligonucleotide
ccggctgaagagtcttctggaaattctcgagaatttccagaagactcttcagtttttg

SEQ ID NO: 1730 - DNA, 58 bp, Artificial Sequence
  Description of Artificial Sequence: Synthetic oligonucleotide
ccggcctcggatggaggttactcttctcgagaagagtaacctccatccgaggtttttg

SEQ ID NO: 1731 - DNA, 58 bp, Artificial Sequence
  Description of Artificial Sequence: Synthetic oligonucleotide
ccgggcagcactgtgcttgtatctactcgagtagatacaagcacagtgctgctttttg

SEQ ID NO: 1732 - DNA, 58 bp, Artificial Sequence
  Description of Artificial Sequence: Synthetic oligonucleotide
ccggtggaggttactctttcaagtactcgagtacttgaaagagtaacctccatttttg

SEQ ID NO: 1733 - DNA, 58 bp, Artificial Sequence
  Description of Artificial Sequence: Synthetic oligonucleotide
ccggaggcactttcctacccaattactcgagtaattgggtaggaaagtgccttttttg

SEQ ID NO: 1734 - DNA, 58 bp, Artificial Sequence
  Description of Artificial Sequence: Synthetic oligonucleotide
ccgggagaatggtgtaccctttattctcgagaataaagggtacaccattctctttttg

SEQ ID NO: 1735 - DNA, 58 bp, Artificial Sequence
  Description of Artificial Sequence: Synthetic oligonucleotide
ccggagacgctgcacttcgagatttctcgagaaatctcgaagtgcagcgtcttttttg

SEQ ID NO: 1736 - DNA, 58 bp, Artificial Sequence
  Description of Artificial Sequence: Synthetic oligonucleotide
ccggcaaatggatgcggtgacaaatctcgagatttgtcaccgcatccatttgtttttg

SEQ ID NO: 1737 - DNA, 58 bp, Artificial Sequence
  Description of Artificial Sequence: Synthetic oligonucleotide
ccgggctggaacgactggatcatagctcgagctatgatccagtcgttccagctttttg

SEQ ID NO: 1738 - DNA, 58 bp, Artificial Sequence
  Description of Artificial Sequence: Synthetic oligonucleotide
ccggtgatgagtacaacatcgtcaactcgagttgacgatgttgtactcatcatttttg

SEQ ID NO: 1739 - DNA, 58 bp, Artificial Sequence
  Description of Artificial Sequence: Synthetic oligonucleotide
ccggtcaaccagactcgtcttgattctcgagaatcaagacgagtctggttgatttttg

SEQ ID NO: 1740 - DNA, 58 bp, Artificial Sequence
  Description of Artificial Sequence: Synthetic oligonucleotide
ccggcaagactgacatacctgacatctcgagatgtcaggtatgtcagtcttgtttttg

SEQ ID NO: 1741 - DNA, 58 bp, Artificial Sequence
  Description of Artificial Sequence: Synthetic oligonucleotide
ccggcaggccagtctcatgttctttctcgagaaagaacatgagactggcctgtttttg

SEQ ID NO: 1742 - DNA, 58 bp, Artificial Sequence
  Description of Artificial Sequence: Synthetic oligonucleotide
ccggctcctctacctggatcataatctcgagattatgatccaggtagaggagtttttg

SEQ ID NO: 1743 - DNA, 58 bp, Artificial Sequence
  Description of Artificial Sequence: Synthetic oligonucleotide
ccggacctgggctggcataccttaactcgagttaaggtatgccagcccaggttttttg

SEQ ID NO: 1744 - DNA, 58 bp, Artificial Sequence
  Description of Artificial Sequence: Synthetic oligonucleotide
ccgggcagcccttcctagagcttaactcgagttaagctctaggaagggctgctttttg

SEQ ID NO: 1745 - DNA, 58 bp, Artificial Sequence
  Description of Artificial Sequence: Synthetic oligonucleotide
ccggccaacgcttcagtgatcaatcctcgaggattgatcactgaagcgttggtttttg

SEQ ID NO: 1746 - DNA, 58 bp, Artificial Sequence
  Description of Artificial Sequence: Synthetic oligonucleotide
ccggtgtagaacacatcaagcatttctcgagaaatgcttgatgtgttctacatttttg

SEQ ID NO: 1747 - DNA, 58 bp, Artificial Sequence
  Description of Artificial Sequence: Synthetic oligonucleotide
ccggcatgatcttgtgacatattatctcgagataatatgtcacaagatcatgtttttg

SEQ ID NO: 1748 - DNA, 58 bp, Artificial Sequence
  Description of Artificial Sequence: Synthetic oligonucleotide
ccggttgaagtgtaccctagcatttctcgagaaatgctagggtacacttcaatttttg

SEQ ID NO: 1749 - DNA, 58 bp, Artificial Sequence
  Description of Artificial Sequence: Synthetic oligonucleotide
ccggcactccaagaacatgactattctcgagaatagtcatgttcttggagtgtttttg

SEQ ID NO: 1750 - DNA, 58 bp, Artificial Sequence
  Description of Artificial Sequence: Synthetic oligonucleotide
ccgggtgaggtcgaaacaggataaactcgagtttatcctgtttcgacctcactttttg

SEQ ID NO: 1751 - DNA, 58 bp, Artificial Sequence
  Description of Artificial Sequence: Synthetic oligonucleotide
ccggtttgtaggaagagggataatactcgagtattatccctcttcctacaaatttttg

SEQ ID NO: 1752 - DNA, 58 bp, Artificial Sequence
  Description of Artificial Sequence: Synthetic oligonucleotide
ccgggccttgcattactgctgatatctcgagatatcagcagtaatgcaaggctttttg

SEQ ID NO: 1753 - DNA, 58 bp, Artificial Sequence; identical to SEQ ID NO: 1752
  Description of Artificial Sequence: Synthetic oligonucleotide

SEQ ID NO: 1754 - DNA, 58 bp, Artificial Sequence
  Description of Artificial Sequence: Synthetic oligonucleotide
ccgggtcgtcagattccagtactatctcgagatagtactggaatctgacgactttttg

SEQ ID NO: 1755 - DNA, 58 bp, Artificial Sequence; identical to SEQ ID NO: 1754
  Description of Artificial Sequence: Synthetic oligonucleotide

SEQ ID NO: 1756 - DNA, 58 bp, Artificial Sequence
  Description of Artificial Sequence: Synthetic oligonucleotide
ccggccacgtctaccttcaccaatactcgagtattggtgaaggtagacgtggtttttg

SEQ ID NO: 1757 - DNA, 58 bp, Artificial Sequence
  Description of Artificial Sequence: Synthetic oligonucleotide
ccggacttcatctaacgagattaaactcgagtttaatctcgttagatgaagttttttg

SEQ ID NO: 1758 - DNA, 58 bp, Artificial Sequence
  Description of Artificial Sequence: Synthetic oligonucleotide
ccgggcgacgagattaggctgttatctcgagataacagcctaatctcgtcgctttttg

SEQ ID NO: 1759 - DNA, 58 bp, Artificial Sequence
  Description of Artificial Sequence: Synthetic oligonucleotide
ccggacgagttggccctagacttagctcgagctaagtctagggccaactcgttttttg

SEQ ID NO: 1760 - DNA, 58 bp, Artificial Sequence
  Description of Artificial Sequence: Synthetic oligonucleotide
ccgggcaggaatcgtgtgactaatactcgagtattagtcacacgattcctgctttttg

SEQ ID NO: 1761 - DNA, 58 bp, Artificial Sequence; identical to SEQ ID NO: 1760
  Description of Artificial Sequence: Synthetic oligonucleotide

SEQ ID NO: 1762 - DNA, 58 bp, Artificial Sequence
  Description of Artificial Sequence: Synthetic oligonucleotide
ccggcctatttaatcctctcgtcaactcgagttgacgagaggattaaataggtttttg

SEQ ID NO: 1763 - DNA, 58 bp, Artificial Sequence
  Description of Artificial Sequence: Synthetic oligonucleotide
ccgggccaatacatggaggttatatctcgagatataacctccatgtattggctttttg

SEQ ID NO: 1764 - DNA, 58 bp, Artificial Sequence
  Description of Artificial Sequence: Synthetic oligonucleotide
ccgggccgcaagaacgaccactaatctcgagattagtggtcgttcttgcggctttttg

SEQ ID NO: 1765 - DNA, 58 bp, Artificial Sequence
  Description of Artificial Sequence: Synthetic oligonucleotide
ccggcacattgtgaatcccatatttctcgagaaatatgggattcacaatgtgtttttg

SEQ ID NO: 1766 - DNA, 58 bp, Artificial Sequence
  Description of Artificial Sequence: Synthetic oligonucleotide
ccggacaagttacctcacctaatttctcgagaaattaggtgaggtaacttgttttttg

SEQ ID NO: 1767 - DNA, 58 bp, Artificial Sequence
  Description of Artificial Sequence: Synthetic oligonucleotide
ccggagcccaatgtgtcattgtttactcgagtaaacaatgacacattgggcttttttg

SEQ ID NO: 1768 - DNA, 58 bp, Artificial Sequence
  Description of Artificial Sequence: Synthetic oligonucleotide
ccggtctctagtgagccctgaatttctcgagaaattcagggctcactagagatttttg

SEQ ID NO: 1769 - DNA, 58 bp, Artificial Sequence
  Description of Artificial Sequence: Synthetic oligonucleotide
ccggagttactccatcccaatttagctcgagctaaattgggatggagtaacttttttg

SEQ ID NO: 1770 - DNA, 58 bp, Artificial Sequence
  Description of Artificial Sequence: Synthetic oligonucleotide
ccggctaagcacttacgtgagtaaactcgagtttactcacgtaagtgcttagtttttg

SEQ ID NO: 1771 - DNA, 58 bp, Artificial Sequence
  Description of Artificial Sequence: Synthetic oligonucleotide
ccggtaggcgcctggtgtatccattctcgagaatggatacaccaggcgcctatttttg

SEQ ID NO: 1772 - DNA, 58 bp, Artificial Sequence
  Description of Artificial Sequence: Synthetic oligonucleotide
ccgggcagtgccaatgccctctttactcgagtaaagagggcattggcactgctttttg

SEQ ID NO: 1773 - DNA, 58 bp, Artificial Sequence
  Description of Artificial Sequence: Synthetic oligonucleotide
ccggaccgcatagtcgtgtaccttgctcgagcaaggtacacgactatgcggttttttg

SEQ ID NO: 1774 - DNA, 58 bp, Artificial Sequence
  Description of Artificial Sequence: Synthetic oligonucleotide
ccggcaacaacctggacaagctatgctcgagcatagcttgtccaggttgttgtttttg

SEQ ID NO: 1775 - DNA, 58 bp, Artificial Sequence
  Description of Artificial Sequence: Synthetic oligonucleotide
ccggtgacttgcgactacgtcattactcgagtaatgacgtagtcgcaagtcatttttg

SEQ ID NO: 1776 - DNA, 58 bp, Artificial Sequence
  Description of Artificial Sequence: Synthetic oligonucleotide
ccggacttctgcagattcgatattactcgagtaatatcgaatctgcagaagttttttg

SEQ ID NO: 1777 - DNA, 58 bp, Artificial Sequence
  Description of Artificial Sequence: Synthetic oligonucleotide
ccgggtaggctcagacataacatttctcgagaaatgttatgtctgagcctactttttg

SEQ ID NO: 1778 - DNA, 58 bp, Artificial Sequence
  Description of Artificial Sequence: Synthetic oligonucleotide
ccgggccctagtactgtcttctttgctcgagcaaagaagacagtactagggctttttg

SEQ ID NO: 1779 - DNA, 58 bp, Artificial Sequence
  Description of Artificial Sequence: Synthetic oligonucleotide
ccgggatcaagtcaccggagctttcctcgaggaaagctccggtgacttgatctttttg

SEQ ID NO: 1780 - DNA, 58 bp, Artificial Sequence
  Description of Artificial Sequence: Synthetic oligonucleotide
ccgggctcccagaagatggtgtatcctcgaggatacaccatcttctgggagctttttg

SEQ ID NO: 1781 - DNA, 58 bp, Artificial Sequence
  Description of Artificial Sequence: Synthetic oligonucleotide
ccgggcgagagggaagaccttctttctcgagaaagaaggtcttccctctcgctttttg

SEQ ID NO: 1782 - DNA, 58 bp, Artificial Sequence
  Description of Artificial Sequence: Synthetic oligonucleotide
ccggcgagagggtgtacgtcaacatctcgagatgttgacgtacaccctctcgtttttg

SEQ ID NO: 1783 - DNA, 58 bp, Artificial Sequence
  Description of Artificial Sequence: Synthetic oligonucleotide
ccgggacgaaggaacaggcgtttctctcgagagaaacgcctgttccttcgtctttttg

SEQ ID NO: 1784 - DNA, 58 bp, Artificial Sequence
  Description of Artificial Sequence: Synthetic oligonucleotide
ccgggatgacctgtgtcgatgtaaactcgagtttacatcgacacaggtcatctttttg

SEQ ID NO: 1785 - DNA, 58 bp, Artificial Sequence
  Description of Artificial Sequence: Synthetic oligonucleotide
ccggggtggaacagtgctgttatttctcgagaaataacagcactgttccacctttttg

SEQ ID NO: 1786 - DNA, 58 bp, Artificial Sequence
  Description of Artificial Sequence: Synthetic oligonucleotide
ccggccgttgaataccgccttgaatctcgagattcaaggcggtattcaacggtttttg

SEQ ID NO: 1787 - DNA, 58 bp, Artificial Sequence
  Description of Artificial Sequence: Synthetic oligonucleotide
ccgggcatcctcaatggatgtgaaactcgagtttcacatccattgaggatgctttttg

SEQ ID NO: 1788 - DNA, 58 bp, Artificial Sequence
  Description of Artificial Sequence: Synthetic oligonucleotide
ccggtgttgttcgggtcggagatttctcgagaaatctccgacccgaacaacatttttg

SEQ ID NO: 1789 - DNA, 58 bp, Artificial Sequence
  Description of Artificial Sequence: Synthetic oligonucleotide
ccggagcgcttcaaggtggtctttgctcgagcaaagaccaccttgaagcgcttttttg

SEQ ID NO: 1790 - DNA, 58 bp, Artificial Sequence
  Description of Artificial Sequence: Synthetic oligonucleotide
ccgggcttcgacatgccagactttgctcgagcaaagtctggcatgtcgaagctttttg

SEQ ID NO: 1791 - DNA, 58 bp, Artificial Sequence
  Description of Artificial Sequence: Synthetic oligonucleotide
ccggtgaaacactacagggtgtatgctcgagcatacaccctgtagtgtttcatttttg

SEQ ID NO: 1792 - DNA, 58 bp, Artificial Sequence
  Description of Artificial Sequence: Synthetic oligonucleotide
ccggcaaccggctttgaaagagttactcgagtaactctttcaaagccggttgtttttg

SEQ ID NO: 1793 - DNA, 58 bp, Artificial Sequence
  Description of Artificial Sequence: Synthetic oligonucleotide
ccggtcagtgggatacgccacatttctcgagaaatgtggcgtatcccactgatttttg

SEQ ID NO: 1794 - DNA, 58 bp, Artificial Sequence
  Description of Artificial Sequence: Synthetic oligonucleotide
ccggtttatggtgtgtgcaagtaaactcgagtttacttgcacacaccataaatttttg

SEQ ID NO: 1795 - DNA, 58 bp, Artificial Sequence
  Description of Artificial Sequence: Synthetic oligonucleotide
ccgggttagagaagaaggctattaactcgagttaatagccttcttctctaactttttg

SEQ ID NO: 1796 - DNA, 58 bp, Artificial Sequence
  Description of Artificial Sequence: Synthetic oligonucleotide
ccggtgttaatgacttcgatctgatctcgagatcagatcgaagtcattaacatttttg

SEQ ID NO: 1797 - DNA, 58 bp, Artificial Sequence
  Description of Artificial Sequence: Synthetic oligonucleotide
ccggctacatcaactattacgacatctcgagatgtcgtaatagttgatgtagtttttg

SEQ ID NO: 1798 - DNA, 58 bp, Artificial Sequence; identical to SEQ ID NO: 1797
  Description of Artificial Sequence: Synthetic oligonucleotide

SEQ ID NO: 1799 - DNA, 58 bp, Artificial Sequence
  Description of Artificial Sequence: Synthetic oligonucleotide
ccgggacagggtctacatcaactatctcgagatagttgatgtagaccctgtctttttg

SEQ ID NO: 1800 - DNA, 58 bp, Artificial Sequence
  Description of Artificial Sequence: Synthetic oligonucleotide
ccgggccaagctgcacaatttaatactcgagtattaaattgtgcagcttggctttttg

SEQ ID NO: 1801 - DNA, 58 bp, Artificial Sequence
  Description of Artificial Sequence: Synthetic oligonucleotide
ccgggctggcactgttcccagataactcgagttatctgggaacagtgccagctttttg

SEQ ID NO: 1802 - DNA, 58 bp, Artificial Sequence
  Description of Artificial Sequence: Synthetic oligonucleotide
ccggagaaagaccactggcagaaacctcgaggtttctgccagtggtctttcttttttg

SEQ ID NO: 1803 - DNA, 58 bp, Artificial Sequence
  Description of Artificial Sequence: Synthetic oligonucleotide
ccggaggcccaactatggatatattctcgagaatatatccatagttgggccttttttg

SEQ ID NO: 1804 - DNA, 58 bp, Artificial Sequence
  Description of Artificial Sequence: Synthetic oligonucleotide
ccgggagctagaaggagatcaaattctcgagaatttgatctccttctagctctttttg

SEQ ID NO: 1805 - DNA, 58 bp, Artificial Sequence
  Description of Artificial Sequence: Synthetic oligonucleotide
ccgggtatgctttaaagtctatttcctcgaggaaatagactttaaagcatactttttg

SEQ ID NO: 1806 - DNA, 58 bp, Artificial Sequence
  Description of Artificial Sequence: Synthetic oligonucleotide
ccggagcgatagctatgacatttatctcgagataaatgtcatagctatcgcttttttg

SEQ ID NO: 1807 - DNA, 58 bp, Artificial Sequence
  Description of Artificial Sequence: Synthetic oligonucleotide
ccgggtgaagatctaagacatttaactcgagttaaatgtcttagatcttcactttttg

SEQ ID NO: 1808 - DNA, 58 bp, Artificial Sequence
  Description of Artificial Sequence: Synthetic oligonucleotide
ccggtacaaggttactcactataaactcgagtttatagtgagtaaccttgtatttttg

SEQ ID NO: 1809 - DNA, 58 bp, Artificial Sequence; identical to SEQ ID NO: 1800
  Description of Artificial Sequence: Synthetic oligonucleotide

SEQ ID NO: 1810 - DNA, 58 bp, Artificial Sequence; identical to SEQ ID NO: 1801
  Description of Artificial Sequence: Synthetic oligonucleotide

SEQ ID NO: 1811 - DNA, 58 bp, Artificial Sequence; identical to SEQ ID NO: 1802
  Description of Artificial Sequence: Synthetic oligonucleotide

SEQ ID NO: 1812 - DNA, 58 bp, Artificial Sequence
  Description of Artificial Sequence: Synthetic oligonucleotide
ccggctgctaaaggttaccgatttcctcgaggaaatcggtaacctttagcagtttttg

SEQ ID NO: 1813 - DNA, 58 bp, Artificial Sequence
  Description of Artificial Sequence: Synthetic oligonucleotide
ccggctctgcatattctagtaataactcgagttattactagaatatgcagagtttttg

SEQ ID NO: 1814 - DNA, 58 bp, Artificial Sequence
  Description of Artificial Sequence: Synthetic oligonucleotide
ccggacggacagctcattcataatgctcgagcattatgaatgagctgtccgttttttg

SEQ ID NO: 1815 - DNA, 58 bp, Artificial Sequence
  Description of Artificial Sequence: Synthetic oligonucleotide
ccggccgttcaaggaaatttctattctcgagaatagaaatttccttgaacggtttttg

SEQ ID NO: 1816 - DNA, 58 bp, Artificial Sequence
  Description of Artificial Sequence: Synthetic oligonucleotide
ccggcgggtctctaagatgtcttatctcgagataagacatcttagagacccgtttttg

SEQ ID NO: 1817 - DNA, 58 bp, Artificial Sequence
  Description of Artificial Sequence: Synthetic oligonucleotide
ccggacctgctcagaaatcataaatctcgagatttatgatttctgagcaggttttttg

SEQ ID NO: 1818 - DNA, 58 bp, Artificial Sequence
  Description of Artificial Sequence: Synthetic oligonucleotide
ccgggtgctcctagatcaccataaactcgagtttatggtgatctaggagcactttttg

SEQ ID NO: 1819 - DNA, 58 bp, Artificial Sequence
  Description of Artificial Sequence: Synthetic oligonucleotide
ccggcacctatagctttcatgtattctcgagaatacatgaaagctataggtgtttttg

SEQ ID NO: 1820 - DNA, 58 bp, Artificial Sequence
  Description of Artificial Sequence: Synthetic oligonucleotide
ccgggcatgctgtatgtggataatgctcgagcattatccacatacagcatgctttttg

SEQ ID NO: 1821 - DNA, 58 bp, Artificial Sequence
  Description of Artificial Sequence: Synthetic oligonucleotide
ccggaggtcagtattatacgttaaactcgagtttaacgtataatactgaccttttttg

SEQ ID NO: 1822 - DNA, 58 bp, Artificial Sequence
  Description of Artificial Sequence: Synthetic oligonucleotide
ccggattctggttgttgctaataatctcgagattattagcaacaaccagaattttttg

SEQ ID NO: 1823 - DNA, 58 bp, Artificial Sequence
  Description of Artificial Sequence: Synthetic oligonucleotide
ccggtgcggaggaagttacagatgtctcgagacatctgtaacttcctccgcatttttg

SEQ ID NO: 1824 - DNA, 58 bp, Artificial Sequence
  Description of Artificial Sequence: Synthetic oligonucleotide
ccgggatatcacagaggcctataacctcgaggttataggcctctgtgatatctttttg

SEQ ID NO: 1825 - DNA, 58 bp, Artificial Sequence
  Description of Artificial Sequence: Synthetic oligonucleotide
ccggggctgattctggagagtatatctcgagatatactctccagaatcagcctttttg

SEQ ID NO: 1826 - DNA, 58 bp, Artificial Sequence
  Description of Artificial Sequence: Synthetic oligonucleotide
ccgggacagtgcctctgccaatatcctcgaggatattggcagaggcactgtctttttg

SEQ ID NO: 1827 - DNA, 58 bp, Artificial Sequence
  Description of Artificial Sequence: Synthetic oligonucleotide
ccggtatactagaatcaccgcatttctcgagaaatgcggtgattctagtatatttttg

SEQ ID NO: 1828 - DNA, 58 bp, Artificial Sequence
  Description of Artificial Sequence: Synthetic oligonucleotide
ccggcagccttgaatgcacttatatctcgagatataagtgcattcaaggctgtttttg

SEQ ID NO: 1829 - DNA, 58 bp, Artificial Sequence; identical to SEQ ID NO: 1828
  Description of Artificial Sequence: Synthetic oligonucleotide

SEQ ID NO: 1830 - DNA, 58 bp, Artificial Sequence
  Description of Artificial Sequence: Synthetic oligonucleotide
ccggcgactgcaagtatgactttatctcgagataaagtcatacttgcagtcgtttttg

SEQ ID NO: 1831 - DNA, 58 bp, Artificial Sequence
  Description of Artificial Sequence: Synthetic oligonucleotide
ccggccggattgctaatgaacagatctcgagatctgttcattagcaatccggtttttg

SEQ ID NO: 1832 - DNA, 58 bp, Artificial Sequence
  Description of Artificial Sequence: Synthetic oligonucleotide
ccggcctcaacttcaaccctcacttctcgagaagtgagggttgaagttgaggtttttg

SEQ ID NO: 1833 - DNA, 58 bp, Artificial Sequence
  Description of Artificial Sequence: Synthetic oligonucleotide
ccggacttcctcctttccgtgtttcctcgaggaaacacggaaaggaggaagttttttg

SEQ ID NO: 1834 - DNA, 58 bp, Artificial Sequence
  Description of Artificial Sequence: Synthetic oligonucleotide
ccggggaccgactttccattgattcctcgaggaatcaatggaaagtcggtcctttttg

SEQ ID NO: 1835 - DNA, 58 bp, Artificial Sequence
  Description of Artificial Sequence: Synthetic oligonucleotide
ccggtggtccttgcactcctgtttcctcgaggaaacaggagtgcaaggaccatttttg

SEQ ID NO: 1836 - DNA, 58 bp, Artificial Sequence
  Description of Artificial Sequence: Synthetic oligonucleotide
ccggtaacctgactcatcgagtttactcgagtaaactcgatgagtcaggttatttttg

SEQ ID NO: 1837 - DNA, 58 bp, Artificial Sequence
  Description of Artificial Sequence: Synthetic oligonucleotide
ccggaggagaaccctcacctaataactcgagttattaggtgagggttctccttttttg

SEQ ID NO: 1838 - DNA, 58 bp, Artificial Sequence
  Description of Artificial Sequence: Synthetic oligonucleotide
ccgggcactccataaggaataatttctcgagaaattattccttatggagtgctttttg

SEQ ID NO: 1839 - DNA, 58 bp, Artificial Sequence
  Description of Artificial Sequence: Synthetic oligonucleotide
ccgggtagccgtgatgtggtcatttctcgagaaatgaccacatcacggctactttttg

SEQ ID NO: 1840 - DNA, 58 bp, Artificial Sequence
  Description of Artificial Sequence: Synthetic oligonucleotide
ccgggcaattgttgaagccctgaatctcgagattcagggcttcaacaattgctttttg

SEQ ID NO: 1841 - DNA, 58 bp, Artificial Sequence
  Description of Artificial Sequence: Synthetic oligonucleotide
ccggactctgagaatcgtgtggaaactcgagtttccacacgattctcagagttttttg

SEQ ID NO: 1842 - DNA, 58 bp, Artificial Sequence
  Description of Artificial Sequence: Synthetic oligonucleotide
ccgggcctctggtatgagaaataaactcgagtttatttctcataccagaggctttttg

SEQ ID NO: 1843 - DNA, 58 bp, Artificial Sequence
  Description of Artificial Sequence: Synthetic oligonucleotide
ccggagtccacgcgcaagaacaaagctcgagctttgttcttgcgcgtggacttttttg

SEQ ID NO: 1844 - DNA, 58 bp, Artificial Sequence
  Description of Artificial Sequence: Synthetic oligonucleotide
ccggtgaccctggttggaatcatagctcgagctatgattccaaccagggtcatttttg

SEQ ID NO: 1845 - DNA, 58 bp, Artificial Sequence
  Description of Artificial Sequence: Synthetic oligonucleotide
ccggacgctgaagaatggaaggaaactcgagtttccttccattcttcagcgttttttg

SEQ ID NO: 1846 - DNA, 58 bp, Artificial Sequence
  Description of Artificial Sequence: Synthetic oligonucleotide
ccggccaactgatagccacgctgaactcgagttcagcgtggctatcagttggtttttg

SEQ ID NO: 1847 - DNA, 58 bp, Artificial Sequence
  Description of Artificial Sequence: Synthetic oligonucleotide
ccggcacgctgaagaatggaaggaactcgagttccttccattcttcagcgtgtttttg

SEQ ID NO: 1848 - DNA, 58 bp, Artificial Sequence
  Description of Artificial Sequence: Synthetic oligonucleotide
ccgggttgtggtatagtcaatctatctcgagatagattgactataccacaactttttg

SEQ ID NO: 1849 - DNA, 58 bp, Artificial Sequence
  Description of Artificial Sequence: Synthetic oligonucleotide
ccggagctgcctaagtgtgcactttctcgagaaagtgcacacttaggcagcttttttg

SEQ ID NO: 1850 - DNA, 58 bp, Artificial Sequence
  Description of Artificial Sequence: Synthetic oligonucleotide
ccggctgacacatcacaatttcatactcgagtatgaaattgtgatgtgtcagtttttg

SEQ ID NO: 1851 - DNA, 58 bp, Artificial Sequence
  Description of Artificial Sequence: Synthetic oligonucleotide
ccgggtgcccactcaggtcacttatctcgagataagtgacctgagtgggcactttttg

SEQ ID NO: 1852 - DNA, 58 bp, Artificial Sequence
  Description of Artificial Sequence: Synthetic oligonucleotide
ccggcttacgctatgtggtggtatcctcgaggataccaccacatagcgtaagtttttg

SEQ ID NO: 1853 - DNA, 58 bp, Artificial Sequence
  Description of Artificial Sequence: Synthetic oligonucleotide
ccggcatcagcttcatgggcaactactcgagtagttgcccatgaagctgatgtttttg

SEQ ID NO: 1854 - DNA, 58 bp, Artificial Sequence
  Description of Artificial Sequence: Synthetic oligonucleotide
ccggcctgtcggtgattgagatgatctcgagatcatctcaatcaccgacaggtttttg

SEQ ID NO: 1855 - DNA, 58 bp, Artificial Sequence; identical to SEQ ID NO: 1854
  Description of Artificial Sequence: Synthetic oligonucleotide

SEQ ID NO: 1856 - DNA, 58 bp, Artificial Sequence
  Description of Artificial Sequence: Synthetic oligonucleotide
ccggcgaaagggaatcctcctgtttctcgagaaacaggaggattccctttcgtttttg

SEQ ID NO: 1857 - DNA, 58 bp, Artificial Sequence
  Description of Artificial Sequence: Synthetic oligonucleotide
ccggaggtgatgaatctgctgattactcgagtaatcagcagattcatcaccttttttg

SEQ ID NO: 1858 - DNA, 58 bp, Artificial Sequence
  Description of Artificial Sequence: Synthetic oligonucleotide
ccggtgtttctgccaaacttctttactcgagtaaagaagtttggcagaaacatttttg

SEQ ID NO: 1859 - DNA, 58 bp, Artificial Sequence
  Description of Artificial Sequence: Synthetic oligonucleotide
ccggctcccaggaagggtagaatttctcgagaaattctacccttcctgggagtttttg

SEQ ID NO: 1860 - DNA, 58 bp, Artificial Sequence
  Description of Artificial Sequence: Synthetic oligonucleotide
ccggagattgcgactggactcaaacctcgaggtttgagtccagtcgcaatcttttttg

SEQ ID NO: 1861 - DNA, 58 bp, Artificial Sequence
  Description of Artificial Sequence: Synthetic oligonucleotide
ccgggttcctgacgtcagtcgaaatctcgagatttcgactgacgtcaggaactttttg

SEQ ID NO: 1862 - DNA, 58 bp, Artificial Sequence
  Description of Artificial Sequence: Synthetic oligonucleotide
ccgggaaggattcttgaccatcaatctcgagattgatggtcaagaatccttctttttg

SEQ ID NO: 1863 - DNA, 58 bp, Artificial Sequence
  Description of Artificial Sequence: Synthetic oligonucleotide
ccggcacctcacaaattgaagtgatctcgagatcacttcaatttgtgaggtgtttttg

SEQ ID NO: 1864 - DNA, 58 bp, Artificial Sequence
  Description of Artificial Sequence: Synthetic oligonucleotide
ccgggccctcatattccaacaacttctcgagaagttgttggaatatgagggctttttg

SEQ ID NO: 1865 - DNA, 58 bp, Artificial Sequence
  Description of Artificial Sequence: Synthetic oligonucleotide
ccgggcttctcaaagcaggagcaatctcgagattgctcctgctttgagaagctttttg

SEQ ID NO: 1866 - DNA, 58 bp, Artificial Sequence
  Description of Artificial Sequence: Synthetic oligonucleotide
ccggcgaggatgagattgccctctactcgagtagagggcaatctcatcctcgtttttg

SEQ ID NO: 1867 - DNA, 58 bp, Artificial Sequence
  Description of Artificial Sequence: Synthetic oligonucleotide
ccggacgacaaggatcaagaattagctcgagctaattcttgatccttgtcgttttttg

SEQ ID NO: 1868 - DNA, 58 bp, Artificial Sequence
  Description of Artificial Sequence: Synthetic oligonucleotide
ccggcctgtctcttatccctttaatctcgagattaaagggataagagacaggtttttg

SEQ ID NO: 1869 - DNA, 58 bp, Artificial Sequence
  Description of Artificial Sequence: Synthetic oligonucleotide
ccgggaaagcagcccagattataatctcgagattataatctgggctgctttctttttg

SEQ ID NO: 1870 - DNA, 58 bp, Artificial Sequence
  Description of Artificial Sequence: Synthetic oligonucleotide
ccggtcatagagggctcccagaagtctcgagacttctgggagccctctatgatttttg

SEQ ID NO: 1871 - DNA, 58 bp, Artificial Sequence
  Description of Artificial Sequence: Synthetic oligonucleotide
ccggcccgtgaaccacctcatagagctcgagctctatgaggtggttcacgggtttttg

SEQ ID NO: 1872 - DNA, 58 bp, Artificial Sequence
  Description of Artificial Sequence: Synthetic oligonucleotide
ccgggactggagcatctacacctgactcgagtcaggtgtagatgctccagtctttttg

SEQ ID NO: 1873 - DNA, 58 bp, Artificial Sequence
  Description of Artificial Sequence: Synthetic oligonucleotide
ccggcaccagagaaataacagacaactcgagttgtctgttatttctctggtgtttttg

SEQ ID NO: 1874 - DNA, 58 bp, Artificial Sequence
  Description of Artificial Sequence: Synthetic oligonucleotide
ccggccatgactcgaatatctgaaactcgagtttcagatattcgagtcatggtttttg

SEQ ID NO: 1875 - DNA, 58 bp, Artificial Sequence; identical to SEQ ID NO: 1874
  Description of Artificial Sequence: Synthetic oligonucleotide

SEQ ID NO: 1876 - DNA, 58 bp, Artificial Sequence
  Description of Artificial Sequence: Synthetic oligonucleotide
ccgggtgcttcctgcaggaccattactcgagtaatggtcctgcaggaagcactttttg

SEQ ID NO: 1877 - DNA, 58 bp, Artificial Sequence
  Description of Artificial Sequence: Synthetic oligonucleotide
ccggagacctctgcaactcggaactctcgagagttccgagttgcagaggtcttttttg

SEQ ID NO: 1878 - DNA, 58 bp, Artificial Sequence
  Description of Artificial Sequence: Synthetic oligonucleotide
ccggctcaagtgctacacctgcaagctcgagcttgcaggtgtagcacttgagtttttg

SEQ ID NO: 1879 - DNA, 58 bp, Artificial Sequence
  Description of Artificial Sequence: Synthetic oligonucleotide
ccgggatgccacagaaatcctttatctcgagataaaggatttctgtggcatctttttg

SEQ ID NO: 1880 - DNA, 58 bp, Artificial Sequence
  Description of Artificial Sequence: Synthetic oligonucleotide
ccggggaactgcgttccaccaaatactcgagtatttggtggaacgcagttcctttttg

SEQ ID NO: 1881 - DNA, 58 bp, Artificial Sequence
  Description of Artificial Sequence: Synthetic oligonucleotide
ccggtgaatcttcacagtaacatttctcgagaaatgttactgtgaagattcatttttg

SEQ ID NO: 1882 - DNA, 58 bp, Artificial Sequence
  Description of Artificial Sequence: Synthetic oligonucleotide
ccgggaagtgagcctgtgatcaatactcgagtattgatcacaggctcacttctttttg

SEQ ID NO: 1883 - DNA, 58 bp, Artificial Sequence
  Description of Artificial Sequence: Synthetic oligonucleotide
ccggtatacgctgcggtggatatacctcgaggtatatccaccgcagcgtatatttttg

SEQ ID NO: 1884 - DNA, 58 bp, Artificial Sequence
  Description of Artificial Sequence: Synthetic oligonucleotide
ccggtcgtgatctcatcacaaataactcgagttatttgtgatgagatcacgatttttg

SEQ ID NO: 1885 - DNA, 58 bp, Artificial Sequence
  Description of Artificial Sequence: Synthetic oligonucleotide
ccgggccctatgacacggatctatactcgagtatagatccgtgtcatagggctttttg

SEQ ID NO: 1886 - DNA, 58 bp, Artificial Sequence
  Description of Artificial Sequence: Synthetic oligonucleotide
ccggagagcttcgccgagaacaactctcgagagttgttctcggcgaagctcttttttg

SEQ ID NO: 1887 - DNA, 58 bp, Artificial Sequence
  Description of Artificial Sequence: Synthetic oligonucleotide
ccggcggatctataccaacgccaaactcgagtttggcgttggtatagatccgtttttg

SEQ ID NO: 1888 - DNA, 58 bp, Artificial Sequence
  Description of Artificial Sequence: Synthetic oligonucleotide
ccggccgtatgtaaatcagatctccctcgagggagatctgatttacatacggtttttg

SEQ ID NO: 1889 - DNA, 58 bp, Artificial Sequence
  Description of Artificial Sequence: Synthetic oligonucleotide
ccggccacaagcagtccagattatactcgagtataatctggactgcttgtggtttttg

SEQ ID NO: 1890 - DNA, 58 bp, Artificial Sequence
  Description of Artificial Sequence: Synthetic oligonucleotide
ccggccgaggtgatagtgtggtttactcgagtaaaccacactatcacctcggtttttg

SEQ ID NO: 1891 - DNA, 58 bp, Artificial Sequence
  Description of Artificial Sequence: Synthetic oligonucleotide
ccggcttcagggttatgtctatgttctcgagaacatagacataaccctgaagtttttg

SEQ ID NO: 1892 - DNA, 58 bp, Artificial Sequence
  Description of Artificial Sequence: Synthetic oligonucleotide
ccgggccctaactacagtcgtttacctcgaggtaaacgactgtagttagggctttttg

SEQ ID NO: 1893 - DNA, 58 bp, Artificial Sequence
  Description of Artificial Sequence: Synthetic oligonucleotide
ccggcctgttgtggtccaagtttaactcgagttaaacttggaccacaacaggtttttg

SEQ ID NO: 1894 - DNA, 58 bp, Artificial Sequence
  Description of Artificial Sequence: Synthetic oligonucleotide
ccggcgcttccaacacgcatatcttctcgagaagatatgcgtgttggaagcgtttttg

SEQ ID NO: 1895 - DNA, 58 bp, Artificial Sequence
  Description of Artificial Sequence: Synthetic oligonucleotide
ccggacaatgtgacccagatgattgctcgagcaatcatctgggtcacattgttttttg

SEQ ID NO: 1896 - DNA, 58 bp, Artificial Sequence
  Description of Artificial Sequence: Synthetic oligonucleotide
ccggctttgtagtttgcccagagttctcgagaactctgggcaaactacaaagtttttg

SEQ ID NO: 1897 - DNA, 58 bp, Artificial Sequence
  Description of Artificial Sequence: Synthetic oligonucleotide
ccggggccatggctgctttgtagttctcgagaactacaaagcagccatggcctttttg

SEQ ID NO: 1898 - DNA, 58 bp, Artificial Sequence
  Description of Artificial Sequence: Synthetic oligonucleotide
ccggggtggctgagatcacaaagcactcgagtgctttgtgatctcagccacctttttg

SEQ ID NO: 1899 - DNA, 58 bp, Artificial Sequence
  Description of Artificial Sequence: Synthetic oligonucleotide
ccggactgcggatctctgtgtcattctcgagaatgacacagagatccgcagttttttg

SEQ ID NO: 1900 - DNA, 58 bp, Artificial Sequence
  Description of Artificial Sequence: Synthetic oligonucleotide
ccggccacaacgaaatctatgacaactcgagttgtcatagatttcgttgtggtttttg

SEQ ID NO: 1901 - DNA, 58 bp, Artificial Sequence; identical to SEQ ID NO: 1900
  Description of Artificial Sequence: Synthetic oligonucleotide

SEQ ID NO: 1902 - DNA, 58 bp, Artificial Sequence
  Description of Artificial Sequence: Synthetic oligonucleotide
ccgggcggcctattgctttagaaatctcgagatttctaaagcaataggccgctttttg

SEQ ID NO: 1903 - DNA, 58 bp, Artificial Sequence
  Description of Artificial Sequence: Synthetic oligonucleotide
ccgggctggagcatgcccgtatttactcgagtaaatacgggcatgctccagctttttg

SEQ ID NO: 1904 - DNA, 58 bp, Artificial Sequence
  Description of Artificial Sequence: Synthetic oligonucleotide
ccggttgctgcctacgtccactttactcgagtaaagtggacgtaggcagcaatttttg

SEQ ID NO: 1905 - DNA, 58 bp, Artificial Sequence
  Description of Artificial Sequence: Synthetic oligonucleotide
ccggcattgccaaacagcgctatatctcgagatatagcgctgtttggcaatgtttttg

SEQ ID NO: 1906 - DNA, 58 bp, Artificial Sequence
  Description of Artificial Sequence: Synthetic oligonucleotide
ccgggctctagggaatctggattatctcgagataatccagattccctagagctttttg

SEQ ID NO: 1907 - DNA, 58 bp, Artificial Sequence
  Description of Artificial Sequence: Synthetic oligonucleotide
ccggcggaatactatgccaaagaaactcgagtttctttggcatagtattccgtttttg

SEQ ID NO: 1908 - DNA, 58 bp, Artificial Sequence
  Description of Artificial Sequence: Synthetic oligonucleotide
ccgggccttgagagtaatggctaaactcgagtttagccattactctcaaggctttttg

SEQ ID NO: 1909 - DNA, 58 bp, Artificial Sequence
  Description of Artificial Sequence: Synthetic oligonucleotide
ccggctcatgttgatggtctatatcctcgaggatatagaccatcaacatgagtttttg

SEQ ID NO: 1910 - DNA, 58 bp, Artificial Sequence
  Description of Artificial Sequence: Synthetic oligonucleotide
ccgggaagttgctgttaagatattcctcgaggaatatcttaacagcaacttctttttg

SEQ ID NO: 1911 - DNA, 58 bp, Artificial Sequence
  Description of Artificial Sequence: Synthetic oligonucleotide
ccggcgttcagaagtcggttaataactcgagttattaaccgacttctgaacgtttttg

SEQ ID NO: 1912 - DNA, 58 bp, Artificial Sequence
  Description of Artificial Sequence: Synthetic oligonucleotide
ccggctctaggctttatcgtgtttactcgagtaaacacgataaagcctagagtttttg

SEQ ID NO: 1913 - DNA, 58 bp, Artificial Sequence
  Description of Artificial Sequence: Synthetic oligonucleotide
ccggctcaggaaatgagattgatttctcgagaaatcaatctcatttcctgagtttttg

SEQ ID NO: 1914 - DNA, 58 bp, Artificial Sequence
  Description of Artificial Sequence: Synthetic oligonucleotide
ccggggagttggtaaagggttaatactcgagtattaaccctttaccaactcctttttg

SEQ ID NO: 1915 - DNA, 58 bp, Artificial Sequence
  Description of Artificial Sequence: Synthetic oligonucleotide
ccggtaatggatttccgggagatatctcgagatatctcccggaaatccattatttttg

SEQ ID NO: 1916 - DNA, 58 bp, Artificial Sequence
  Description of Artificial Sequence: Synthetic oligonucleotide
ccggcacacccagggctagtataaactcgagtttatactagccctgggtgtgtttttg

SEQ ID NO: 1917 - DNA, 58 bp, Artificial Sequence
  Description of Artificial Sequence: Synthetic oligonucleotide
ccgggtaggttatgatgagtttaatctcgagattaaactcatcataacctactttttg

SEQ ID NO: 1918 - DNA, 58 bp, Artificial Sequence
  Description of Artificial Sequence: Synthetic oligonucleotide
ccggcgtgactgtaagattgtaaatctcgagatttacaatcttacagtcacgtttttg

SEQ ID NO: 1919 - DNA, 58 bp, Artificial Sequence
  Description of Artificial Sequence: Synthetic oligonucleotide
ccgggagatccctaatcatcaaattctcgagaatttgatgattagggatctctttttg

SEQ ID NO: 1920 - DNA, 58 bp, Artificial Sequence
  Description of Artificial Sequence: Synthetic oligonucleotide
ccgggagccgatcaagactgtgtttctcgagaaacacagtcttgatcggctctttttg

SEQ ID NO: 1921 - DNA, 58 bp, Artificial Sequence
  Description of Artificial Sequence: Synthetic oligonucleotide
ccgggctgccattgagagtgttcaactcgagttgaacactctcaatggcagctttttg

SEQ ID NO: 1922 - DNA, 58 bp, Artificial Sequence; identical to SEQ ID NO: 1921
  Description of Artificial Sequence: Synthetic oligonucleotide

SEQ ID NO: 1923 - DNA, 58 bp, Artificial Sequence
  Description of Artificial Sequence: Synthetic oligonucleotide
ccgggacctccgagtcctcagtaaactcgagtttactgaggactcggaggtctttttg

SEQ ID NO: 1924 - DNA, 58 bp, Artificial Sequence
  Description of Artificial Sequence: Synthetic oligonucleotide
ccggagctagctctttggtctatttctcgagaaatagaccaaagagctagcttttttg

SEQ ID NO: 1925 - DNA, 58 bp, Artificial Sequence
  Description of Artificial Sequence: Synthetic oligonucleotide
ccggcaacctccagcctggatattcctcgaggaatatccaggctggaggttgtttttg

SEQ ID NO: 1926 - DNA, 58 bp, Artificial Sequence
  Description of Artificial Sequence: Synthetic oligonucleotide
ccgggcacagtgtttccctgtttatctcgagataaacagggaaacactgtgctttttg

SEQ ID NO: 1927 - DNA, 58 bp, Artificial Sequence; identical to SEQ ID NO: 1926
  Description of Artificial Sequence: Synthetic oligonucleotide

SEQ ID NO: 1928 - DNA, 58 bp, Artificial Sequence
  Description of Artificial Sequence: Synthetic oligonucleotide
ccggacagacggccttctgcaattcctcgaggaattgcagaaggccgtctgttttttg

SEQ ID NO: 1929 - DNA, 58 bp, Artificial Sequence
  Description of Artificial Sequence: Synthetic oligonucleotide
ccgggaacccaagcttagaactttactcgagtaaagttctaagcttgggttctttttg

SEQ ID NO: 1930 - DNA, 58 bp, Artificial Sequence
  Description of Artificial Sequence: Synthetic oligonucleotide
ccggggagccagctccctctatttactcgagtaaatagagggagctggctcctttttg

SEQ ID NO: 1931 - DNA, 58 bp, Artificial Sequence
  Description of Artificial Sequence: Synthetic oligonucleotide
ccggtggcgtggagctgagagataactcgagttatctctcagctccacgccatttttg

SEQ ID NO: 1932 - DNA, 58 bp, Artificial Sequence
  Description of Artificial Sequence: Synthetic oligonucleotide
ccgggcacgtggtgtaacctcagaactcgagttctgaggttacaccacgtgctttttg

SEQ ID NO: 1933 - DNA, 58 bp, Artificial Sequence
  Description of Artificial Sequence: Synthetic oligonucleotide
ccggcagcaatagctcggacgcaatctcgagattgcgtccgagctattgctgtttttg

SEQ ID NO: 1934 - DNA, 58 bp, Artificial Sequence
  Description of Artificial Sequence: Synthetic oligonucleotide
ccgggacagctacaagcctggagttctcgagaactccaggcttgtagctgtctttttg

SEQ ID NO: 1935 - DNA, 58 bp, Artificial Sequence
  Description of Artificial Sequence: Synthetic oligonucleotide
ccgggcttctacaacgacgtggtcactcgagtgaccacgtcgttgtagaagctttttg

SEQ ID NO: 1936 - DNA, 58 bp, Artificial Sequence
  Description of Artificial Sequence: Synthetic oligonucleotide
ccggtgtttacttgcccggtttaatctcgagattaaaccgggcaagtaaacatttttg

SEQ ID NO: 1937 - DNA, 58 bp, Artificial Sequence
  Description of Artificial Sequence: Synthetic oligonucleotide
ccggtgtaccagtgagaagcattatctcgagataatgcttctcactggtacatttttg

SEQ ID NO: 1938 - DNA, 58 bp, Artificial Sequence
  Description of Artificial Sequence: Synthetic oligonucleotide
ccggtgggacggtgctgtaacaaatctcgagatttgttacagcaccgtcccatttttg

SEQ ID NO: 1939 - DNA, 58 bp, Artificial Sequence
  Description of Artificial Sequence: Synthetic oligonucleotide
ccgggaaagcactcacagctaatttctcgagaaattagctgtgagtgctttctttttg

SEQ ID NO: 1940 - DNA, 58 bp, Artificial Sequence
  Description of Artificial Sequence: Synthetic oligonucleotide
ccgggataaatgcttgctgcataaactcgagtttatgcagcaagcatttatctttttg

SEQ ID NO: 1941 - DNA, 58 bp, Artificial Sequence
  Description of Artificial Sequence: Synthetic oligonucleotide
ccggccagtgtgtgttcattgtaaactcgagtttacaatgaacacacactggtttttg

SEQ ID NO: 1942 - DNA, 58 bp, Artificial Sequence
  Description of Artificial Sequence: Synthetic oligonucleotide
ccggagaaccagtaccggcattattctcgagaataatgccggtactggttcttttttg

SEQ ID NO: 1943 - DNA, 58 bp, Artificial Sequence
  Description of Artificial Sequence: Synthetic oligonucleotide
ccggggagctgttggtgggaatatactcgagtatattcccaccaacagctcctttttg

SEQ ID NO: 1944 - DNA, 58 bp, Artificial Sequence
  Description of Artificial Sequence: Synthetic oligonucleotide
ccggcttgaaggaactactactaagctcgagcttagtagtagttccttcaagtttttg

SEQ ID NO: 1945 - DNA, 58 bp, Artificial Sequence
  Description of Artificial Sequence: Synthetic oligonucleotide
ccgggctccgtttctctgttgttaactcgagttaacaacagagaaacggagctttttg

SEQ ID NO: 1946 - DNA, 58 bp, Artificial Sequence
  Description of Artificial Sequence: Synthetic oligonucleotide
ccggcaagaacaccatcctacataactcgagttatgtaggatggtgttcttgtttttg

SEQ ID NO: 1947 - DNA, 58 bp, Artificial Sequence
  Description of Artificial Sequence: Synthetic oligonucleotide
ccggcagtccctgtcctccaaatagctcgagctatttggaggacagggactgtttttg

SEQ ID NO: 1948 - DNA, 58 bp, Artificial Sequence
  Description of Artificial Sequence: Synthetic oligonucleotide
ccggcaagttggaccttgatatttactcgagtaaatatcaaggtccaacttgtttttg

SEQ ID NO: 1949 - DNA, 58 bp, Artificial Sequence
  Description of Artificial Sequence: Synthetic oligonucleotide
ccggctactatgtcttctttcaactctcgagagttgaaagaagacatagtagtttttg

SEQ ID NO: 1950 - DNA, 58 bp, Artificial Sequence
  Description of Artificial Sequence: Synthetic oligonucleotide
ccggcccttcaccgaggtcggaatactcgagtattccgacctcggtgaagggtttttg

SEQ ID NO: 1951 - DNA, 58 bp, Artificial Sequence
  Description of Artificial Sequence: Synthetic oligonucleotide
ccggtgagctacaaagaggacacgactcgagtcgtgtcctctttgtagctcatttttg

SEQ ID NO: 1952 - DNA, 58 bp, Artificial Sequence
  Description of Artificial Sequence: Synthetic oligonucleotide
ccggagaaatagttgttggtctaaactcgagtttagaccaacaactatttcttttttg

SEQ ID NO: 1953 - DNA, 58 bp, Artificial Sequence
  Description of Artificial Sequence: Synthetic oligonucleotide
ccggagttatcctgaccctatattgctcgagcaatatagggtcaggataacttttttg

SEQ ID NO: 1954 - DNA, 58 bp, Artificial Sequence
  Description of Artificial Sequence: Synthetic oligonucleotide
ccgggacaaacaaatggtccaatatctcgagatattggaccatttgtttgtctttttg

SEQ ID NO: 1955 - DNA, 58 bp, Artificial Sequence
  Description of Artificial Sequence: Synthetic oligonucleotide
ccggctaatggtgtacgtcactaaactcgagtttagtgacgtacaccattagtttttg

SEQ ID NO: 1956 - DNA, 58 bp, Artificial Sequence
  Description of Artificial Sequence: Synthetic oligonucleotide
ccggccggatcaggatgcaacatacctcgaggtatgttgcatcctgatccggtttttg

SEQ ID NO: 1957 - DNA, 58 bp, Artificial Sequence
  Description of Artificial Sequence: Synthetic oligonucleotide
ccgggcagtatatttcttcgttcttctcgagaagaacgaagaaatatactgctttttg

SEQ ID NO: 1958 - DNA, 58 bp, Artificial Sequence
  Description of Artificial Sequence: Synthetic oligonucleotide
ccgggtattcccactcttatcttacctcgaggtaagataagagtgggaatactttttg

SEQ ID NO: 1959 - DNA, 58 bp, Artificial Sequence
  Description of Artificial Sequence: Synthetic oligonucleotide
ccgggggcattgtgttcactgtactctcgagagtacagtgaacacaatgccctttttg

SEQ ID NO: 1960 - DNA, 58 bp, Artificial Sequence
  Description of Artificial Sequence: Synthetic oligonucleotide
ccggcagatggaggttacacaacttctcgagaagttgtgtaacctccatctgtttttg

SEQ ID NO: 1961 - DNA, 58 bp, Artificial Sequence
  Description of Artificial Sequence: Synthetic oligonucleotide
ccggcctcacctacttcggactcttctcgagaagagtccgaagtaggtgaggtttttg

SEQ ID NO: 1962 - DNA, 58 bp, Artificial Sequence
  Description of Artificial Sequence: Synthetic oligonucleotide
ccggctgtactgtcaggtgcactttctcgagaaagtgcacctgacagtacagtttttg

SEQ ID NO: 1963 - DNA, 58 bp, Artificial Sequence
  Description of Artificial Sequence: Synthetic oligonucleotide
ccgggcgcaggcagatggaggttacctcgaggtaacctccatctgcctgcgctttttg

SEQ ID NO: 1964 - DNA, 58 bp, Artificial Sequence
  Description of Artificial Sequence: Synthetic oligonucleotide
ccggcagttgccctctggttgagttctcgagaactcaaccagagggcaactgtttttg

SEQ ID NO: 1965 - DNA, 58 bp, Artificial Sequence
  Description of Artificial Sequence: Synthetic oligonucleotide
ccggatggctctgctgacccaacaactcgagttgttgggtcagcagagccattttttg

SEQ ID NO: 1966 - DNA, 58 bp, Artificial Sequence
  Description of Artificial Sequence: Synthetic oligonucleotide
ccggcccaacaaacagagctgcagactcgagtctgcagctctgtttgttgggtttttg

SEQ ID NO: 1967 - DNA, 58 bp, Artificial Sequence
  Description of Artificial Sequence: Synthetic oligonucleotide
ccggcctgaaacactacccaataatctcgagattattgggtagtgtttcaggtttttg

SEQ ID NO: 1968 - DNA, 58 bp, Artificial Sequence
  Description of Artificial Sequence: Synthetic oligonucleotide
ccggctacgccatgggacatctaatctcgagattagatgtcccatggcgtagtttttg

SEQ ID NO: 1969 - DNA, 58 bp, Artificial Sequence
  Description of Artificial Sequence: Synthetic oligonucleotide
ccgggtgactttgtttcgatgtattctcgagaatacatcgaaacaaagtcactttttg

SEQ ID NO: 1970 - DNA, 58 bp, Artificial Sequence
  Description of Artificial Sequence: Synthetic oligonucleotide
ccggtcctgggagcagctgatacaactcgagttgtatcagctgctcccaggatttttg

SEQ ID NO: 1971 - DNA, 58 bp, Artificial Sequence
  Description of Artificial Sequence: Synthetic oligonucleotide
ccgggacagaccgacatcccattcactcgagtgaatgggatgtcggtctgtctttttg

SEQ ID NO: 1972 - DNA, 58 bp, Artificial Sequence
  Description of Artificial Sequence: Synthetic oligonucleotide
ccggatgggtctgacacgtggagaactcgagttctccacgtgtcagacccattttttg

SEQ ID NO: 1973 - DNA, 58 bp, Artificial Sequence
  Description of Artificial Sequence: Synthetic oligonucleotide
ccggattaagacactgatcactaaactcgagtttagtgatcagtgtcttaattttttg

SEQ ID NO: 1974 - DNA, 58 bp, Artificial Sequence
  Description of Artificial Sequence: Synthetic oligonucleotide
ccgggtcgggagactacttcatttactcgagtaaatgaagtagtctcccgactttttg

SEQ ID NO: 1975 - DNA, 58 bp, Artificial Sequence
  Description of Artificial Sequence: Synthetic oligonucleotide
ccggactataggaggagagcaaatactcgagtatttgctctcctcctatagttttttg

SEQ ID NO: 1976 - DNA, 58 bp, Artificial Sequence
  Description of Artificial Sequence: Synthetic oligonucleotide
ccggccttcagttggctaatctttactcgagtaaagattagccaactgaaggtttttg

SEQ ID NO: 1977 - DNA, 58 bp, Artificial Sequence
  Description of Artificial Sequence: Synthetic oligonucleotide
ccggctgaacctccttgcgtgaatactcgagtattcacgcaaggaggttcagtttttg

SEQ ID NO: 1978 - DNA, 58 bp, Artificial Sequence
  Description of Artificial Sequence: Synthetic oligonucleotide
ccggatgatacaaactctaacaaacctcgaggtttgttagagtttgtatcattttttg

SEQ ID NO: 1979 - DNA, 58 bp, Artificial Sequence
  Description of Artificial Sequence: Synthetic oligonucleotide
ccgggtggcctctctgacttacaaactcgagtttgtaagtcagagaggccactttttg

SEQ ID NO: 1980 - DNA, 58 bp, Artificial Sequence
  Description of Artificial Sequence: Synthetic oligonucleotide
ccgggcagaacaactcagtcatcatctcgagatgatgactgagttgttctgctttttg

SEQ ID NO: 1981 - DNA, 58 bp, Artificial Sequence
  Description of Artificial Sequence: Synthetic oligonucleotide
ccgggccaagattcgagaggaacaactcgagttgttcctctcgaatcttggctttttg

SEQ ID NO: 1982 - DNA, 58 bp, Artificial Sequence
  Description of Artificial Sequence: Synthetic oligonucleotide
ccggactgtatggtcttgatctattctcgagaatagatcaagaccatacagttttttg

SEQ ID NO: 1983 - DNA, 58 bp, Artificial Sequence
  Description of Artificial Sequence: Synthetic oligonucleotide
ccggcaaactacacagggtattaaactcgagtttaataccctgtgtagtttgtttttg

SEQ ID NO: 1984 - DNA, 58 bp, Artificial Sequence
  Description of Artificial Sequence: Synthetic oligonucleotide
ccgggtggatacattccagtacatactcgagtatgtactggaatgtatccactttttg

SEQ ID NO: 1985 - DNA, 58 bp, Artificial Sequence; identical to SEQ ID NO: 1948
  Description of Artificial Sequence: Synthetic oligonucleotide

SEQ ID NO: 1986 - DNA, 58 bp, Artificial Sequence; identical to SEQ ID NO: 1949
  Description of Artificial Sequence: Synthetic oligonucleotide

SEQ ID NO: 1987 - DNA, 58 bp, Artificial Sequence; identical to SEQ ID NO: 1950
  Description of Artificial Sequence: Synthetic oligonucleotide

SEQ ID NO: 1988 - DNA, 58 bp, Artificial Sequence
  Description of Artificial Sequence: Synthetic oligonucleotide
ccgggccgttgttcagcgcaaatatctcgagatatttgcgctgaacaacggctttttg

SEQ ID NO: 1989 - DNA, 58 bp, Artificial Sequence; identical to SEQ ID NO: 1988
  Description of Artificial Sequence: Synthetic oligonucleotide

SEQ ID NO: 1990 - DNA, 58 bp, Artificial Sequence
  Description of Artificial Sequence: Synthetic oligonucleotide
ccggccgcatcaggtgaacatcaaactcgagtttgatgttcacctgatgcggtttttg

SEQ ID NO: 1991 - DNA, 58 bp, Artificial Sequence
  Description of Artificial Sequence: Synthetic oligonucleotide
ccggactcaatgatagcacctaaacctcgaggtttaggtgctatcattgagttttttg

SEQ ID NO: 1992 - DNA, 58 bp, Artificial Sequence
  Description of Artificial Sequence: Synthetic oligonucleotide
ccggcgtcgcttcaatcgacctttactcgagtaaaggtcgattgaagcgacgtttttg

SEQ ID NO: 1993 - DNA, 58 bp, Artificial Sequence
  Description of Artificial Sequence: Synthetic oligonucleotide
ccggccatctttattatggtcatatctcgagatatgaccataataaagatggtttttg

SEQ ID NO: 1994 - DNA, 58 bp, Artificial Sequence
  Description of Artificial Sequence: Synthetic oligonucleotide
ccgggactgtgttggtatgtgtaatctcgagattacacataccaacacagtctttttg

SEQ ID NO: 1995 - DNA, 58 bp, Artificial Sequence
  Description of Artificial Sequence: Synthetic oligonucleotide
ccgggcgccttattccagtgacaaactcgagtttgtcactggaataaggcgctttttg

SEQ ID NO: 1996 - DNA, 58 bp, Artificial Sequence
  Description of Artificial Sequence: Synthetic oligonucleotide
ccgggaatcactgagctgtaacaaactcgagtttgttacagctcagtgattctttttg

SEQ ID NO: 1997 - DNA, 58 bp, Artificial Sequence
  Description of Artificial Sequence: Synthetic oligonucleotide
ccgggcacatactgtgtggacaatactcgagtattgtccacacagtatgtgctttttg

SEQ ID NO: 1998 - DNA, 58 bp, Artificial Sequence
  Description of Artificial Sequence: Synthetic oligonucleotide
ccggtgctgatgcagacattgaatactcgagtattcaatgtctgcatcagcatttttg

SEQ ID NO: 1999 - DNA, 58 bp, Artificial Sequence
  Description of Artificial Sequence: Synthetic oligonucleotide
ccggagcgaggtattcaccacattcctcgaggaatgtggtgaatacctcgcttttttg

SEQ ID NO: 2000 - DNA, 58 bp, Artificial Sequence
  Description of Artificial Sequence: Synthetic oligonucleotide
ccggagcttgactacgccgactttgctcgagcaaagtcggcgtagtcaagcttttttg

SEQ ID NO: 2001 - DNA, 58 bp, Artificial Sequence
  Description of Artificial Sequence: Synthetic oligonucleotide
ccggagccaacaggctgcatgaaatctcgagatttcatgcagcctgttggcttttttg

SEQ ID NO: 2002 - DNA, 58 bp, Artificial Sequence
  Description of Artificial Sequence: Synthetic oligonucleotide
ccgggagatcctttcccatttattcctcgaggaataaatgggaaaggatctctttttg

SEQ ID NO: 2003 - DNA, 58 bp, Artificial Sequence
  Description of Artificial Sequence: Synthetic oligonucleotide
ccggcaagatccgcagacgtgtaaactcgagtttacacgtctgcggatcttgtttttg

SEQ ID NO: 2004 - DNA, 58 bp, Artificial Sequence; identical to SEQ ID NO: 2003
  Description of Artificial Sequence: Synthetic oligonucleotide

SEQ ID NO: 2005 - DNA, 58 bp, Artificial Sequence
  Description of Artificial Sequence: Synthetic oligonucleotide
ccgggcgcaagaaatcccggtataactcgagttataccgggatttcttgcgctttttg

SEQ ID NO: 2006 - DNA, 58 bp, Artificial Sequence
  Description of Artificial Sequence: Synthetic oligonucleotide
ccggatgaatatgcggcactgaaagctcgagctttcagtgccgcatattcattttttg

SEQ ID NO: 2007 - DNA, 58 bp, Artificial Sequence
  Description of Artificial Sequence: Synthetic oligonucleotide
ccggcattcccagaatgtgacatttctcgagaaatgtcacattctgggaatgtttttg

SEQ ID NO: 2008 - DNA, 58 bp, Artificial Sequence
  Description of Artificial Sequence: Synthetic oligonucleotide
ccgggagtgacctatgctgagctaactcgagttagctcagcataggtcactctttttg

SEQ ID NO: 2009 - DNA, 58 bp, Artificial Sequence
  Description of Artificial Sequence: Synthetic oligonucleotide
ccggtgcgccctgatcagatgtatgctcgagcatacatctgatcagggcgcatttttg

SEQ ID NO: 2010 - DNA, 58 bp, Artificial Sequence
  Description of Artificial Sequence: Synthetic oligonucleotide
ccggggacgtgctcaaggatgacaactcgagttgtcatccttgagcacgtcctttttg

SEQ ID NO: 2011 - DNA, 58 bp, Artificial Sequence
  Description of Artificial Sequence: Synthetic oligonucleotide
ccggagtgctgcatcaacgtgtgtgctcgagcacacacgttgatgcagcacttttttg

SEQ ID NO: 2012 - DNA, 58 bp, Artificial Sequence
  Description of Artificial Sequence: Synthetic oligonucleotide
ccggtcaagttcttgggcaccaagtctcgagacttggtgcccaagaacttgatttttg

SEQ ID NO: 2013 - DNA, 58 bp, Artificial Sequence
  Description of Artificial Sequence: Synthetic oligonucleotide
ccggtacaaccgctgctatatggacctcgaggtccatatagcagcggttgtatttttg

SEQ ID NO: 2014 - DNA, 58 bp, Artificial Sequence
  Description of Artificial Sequence: Synthetic oligonucleotide
ccggcaccagcttgctcagatattcctcgaggaatatctgagcaagctggtgtttttg

SEQ ID NO: 2015 - DNA, 58 bp, Artificial Sequence
  Description of Artificial Sequence: Synthetic oligonucleotide
ccggctgtcgagaaacggcgtttatctcgagataaacgccgtttctcgacagtttttg

SEQ ID NO: 2016 - DNA, 58 bp, Artificial Sequence
  Description of Artificial Sequence: Synthetic oligonucleotide
ccgggacctcgtctacttcgagaaactcgagtttctcgaagtagacgaggtctttttg

SEQ ID NO: 2017 - DNA, 58 bp, Artificial Sequence
  Description of Artificial Sequence: Synthetic oligonucleotide
ccgggccacgagtttggatgttgtactcgagtacaacatccaaactcgtggctttttg

SEQ ID NO: 2018 - DNA, 58 bp, Artificial Sequence
  Description of Artificial Sequence: Synthetic oligonucleotide
ccggccacaaatggtcccaattaagctcgagcttaattgggaccatttgtggtttttg

SEQ ID NO: 2019 - DNA, 58 bp, Artificial Sequence
  Description of Artificial Sequence: Synthetic oligonucleotide
ccggtcgggaatctgcctttgtttactcgagtaaacaaaggcagattcccgatttttg

SEQ ID NO: 2020 - DNA, 58 bp, Artificial Sequence
  Description of Artificial Sequence: Synthetic oligonucleotide
ccggttgactatgggatcaaatttgctcgagcaaatttgatcccatagtcaatttttg

SEQ ID NO: 2021 - DNA, 58 bp, Artificial Sequence
  Description of Artificial Sequence: Synthetic oligonucleotide
ccggctcccaggacccgcttatttactcgagtaaataagcgggtcctgggagtttttg

SEQ ID NO: 2022 - DNA, 58 bp, Artificial Sequence
  Description of Artificial Sequence: Synthetic oligonucleotide
ccggcaaagaatgccagtatcaattctcgagaattgatactggcattctttgtttttg

SEQ ID NO: 2023 - DNA, 58 bp, Artificial Sequence
  Description of Artificial Sequence: Synthetic oligonucleotide
ccggcctgttcagatgtcagaagtactcgagtacttctgacatctgaacaggtttttg

SEQ ID NO: 2024 - DNA, 58 bp, Artificial Sequence
  Description of Artificial Sequence: Synthetic oligonucleotide
ccggcataggagaaggctcacaaatctcgagatttgtgagccttctcctatgtttttg

SEQ ID NO: 2025 - DNA, 58 bp, Artificial Sequence
  Description of Artificial Sequence: Synthetic oligonucleotide
ccggggcgcaagcatcatctgtaacctcgaggttacagatgatgcttgcgcctttttg

SEQ ID NO: 2026 - DNA, 58 bp, Artificial Sequence
  Description of Artificial Sequence: Synthetic oligonucleotide
ccggtcttcgggaaggagctcaaagctcgagctttgagctccttcccgaagatttttg

SEQ ID NO: 2027 - DNA, 58 bp, Artificial Sequence
  Description of Artificial Sequence: Synthetic oligonucleotide
ccgggctgtgacaatggcaacaattctcgagaattgttgccattgtcacagctttttg

SEQ ID NO: 2028 - DNA, 58 bp, Artificial Sequence
  Description of Artificial Sequence: Synthetic oligonucleotide
ccggttcaacttgtctctataatagctcgagctattatagagacaagttgaatttttg

SEQ ID NO: 2029 - DNA, 58 bp, Artificial Sequence
  Description of Artificial Sequence: Synthetic oligonucleotide
ccggagattctggctagtgtctatcctcgaggatagacactagccagaatcttttttg

SEQ ID NO: 2030 - DNA, 58 bp, Artificial Sequence
  Description of Artificial Sequence: Synthetic oligonucleotide
ccggactgccagttagcagaatcaactcgagttgattctgctaactggcagttttttg

SEQ ID NO: 2031 - DNA, 58 bp, Artificial Sequence
  Description of Artificial Sequence: Synthetic oligonucleotide
ccgggtagggagtgaagtctcacatctcgagatgtgagacttcactccctactttttg

SEQ ID NO: 2032 - DNA, 58 bp, Artificial Sequence
  Description of Artificial Sequence: Synthetic oligonucleotide
ccgggaaatccaacaccagaaataactcgagttatttctggtgttggatttctttttg

SEQ ID NO: 2033 - DNA, 58 bp, Artificial Sequence
  Description of Artificial Sequence: Synthetic oligonucleotide
ccgggatccgaccctgatgaatatgctcgagcatattcatcagggtcggatctttttg

SEQ ID NO: 2034 - DNA, 58 bp, Artificial Sequence
  Description of Artificial Sequence: Synthetic oligonucleotide
ccggatctgtctcctagaatcttatctcgagataagattctaggagacagattttttg

SEQ ID NO: 2035 - DNA, 58 bp, Artificial Sequence
  Description of Artificial Sequence: Synthetic oligonucleotide
ccggccctttatttatgacgactttctcgagaaagtcgtcataaataaagggtttttg

SEQ ID NO: 2036 - DNA, 58 bp, Artificial Sequence
  Description of Artificial Sequence: Synthetic oligonucleotide
aattcaaaaaaggcgtccctataccaaataactcgagttatttggtatagggacgcct

SEQ ID NO: 2037 - DNA, 58 bp, Artificial Sequence
  Description of Artificial Sequence: Synthetic oligonucleotide
aattcaaaaaagactgcatcaatcgtcataactcgagttatgacgattgatgcagtct

SEQ ID NO: 2038 - DNA, 58 bp, Artificial Sequence
  Description of Artificial Sequence: Synthetic oligonucleotide
aattcaaaaacctccagacatccttgaaatactcgagtatttcaaggatgtctggagg

SEQ ID NO: 2039 - DNA, 58 bp, Artificial Sequence
  Description of Artificial Sequence: Synthetic oligonucleotide
aattcaaaaaatcctgtgggcctggtttattctcgagaataaaccaggcccacaggat

SEQ ID NO: 2040 - DNA, 58 bp, Artificial Sequence
  Description of Artificial Sequence: Synthetic oligonucleotide
aattcaaaaatggcagaagccctggcaatttctcgagaaattgccagggcttctgcca

SEQ ID NO: 2041 - DNA, 58 bp, Artificial Sequence
  Description of Artificial Sequence: Synthetic oligonucleotide
aattcaaaaaggcggatggttgagatctatcctcgaggatagatctcaaccatccgcc

SEQ ID NO: 2042 - DNA, 58 bp, Artificial Sequence
  Description of Artificial Sequence: Synthetic oligonucleotide
aattcaaaaagagcactctttatactattaactcgagttaatagtataaagagtgctc

SEQ ID NO: 2043 - DNA, 58 bp, Artificial Sequence
  Description of Artificial Sequence: Synthetic oligonucleotide
aattcaaaaagtggaactgccacgcagatttctcgagaaatctgcgtggcagttccac

SEQ ID NO: 2044 - DNA, 58 bp, Artificial Sequence
  Description of Artificial Sequence: Synthetic oligonucleotide
aattcaaaaacattgggtcttcgggagtttcctcgaggaaactcccgaagacccaatg

SEQ ID NO: 2045 - DNA, 58 bp, Artificial Sequence
  Description of Artificial Sequence: Synthetic oligonucleotide
aattcaaaaacactattggtgtaccttataactcgagttataaggtacaccaatagtg

SEQ ID NO: 2046 - DNA, 58 bp, Artificial Sequence
  Description of Artificial Sequence: Synthetic oligonucleotide
aattcaaaaaggcatagtgctgacatatattctcgagaatatatgtcagcactatgcc

SEQ ID NO: 2047 - DNA, 58 bp, Artificial Sequence
  Description of Artificial Sequence: Synthetic oligonucleotide
aattcaaaaagccgttcccttctccattatcctcgaggataatggagaagggaacggc

SEQ ID NO: 2048 - DNA, 58 bp, Artificial Sequence
  Description of Artificial Sequence: Synthetic oligonucleotide
aattcaaaaatgataattccctcgacaaattctcgagaatttgtcgagggaattatca

SEQ ID NO: 2049 - DNA, 58 bp, Artificial Sequence
  Description of Artificial Sequence: Synthetic oligonucleotide
aattcaaaaagcagaacgtatttagccattactcgagtaatggctaaatacgttctgc

SEQ ID NO: 2050 - DNA, 58 bp, Artificial Sequence
  Description of Artificial Sequence: Synthetic oligonucleotide
aattcaaaaactggtctgtctttggataatactcgagtattatccaaagacagaccag

SEQ ID NO: 2051 - DNA, 58 bp, Artificial Sequence
  Description of Artificial Sequence: Synthetic oligonucleotide
aattcaaaaaatgtcacgaggcctctcatacctcgaggtatgagaggcctcgtgacat

SEQ ID NO: 2052 - DNA, 58 bp, Artificial Sequence
  Description of Artificial Sequence: Synthetic oligonucleotide
aattcaaaaacccagctcatgaatgactttgctcgagcaaagtcattcatgagctggg

SEQ ID NO: 2053 - DNA, 58 bp, Artificial Sequence
  Description of Artificial Sequence: Synthetic oligonucleotide
aattcaaaaactttggcttggctgttcgattctcgagaatcgaacagccaagccaaag

SEQ ID NO: 2054 - DNA, 58 bp, Artificial Sequence
  Description of Artificial Sequence: Synthetic oligonucleotide
aattcaaaaaccgggagactgagatctataactcgagttatagatctcagtctcccgg

SEQ ID NO: 2055 - DNA, 58 bp, Artificial Sequence
  Description of Artificial Sequence: Synthetic oligonucleotide
aattcaaaaacaggagcacctgattcctttcctcgaggaaaggaatcaggtgctcctg

SEQ ID NO: 2056 - DNA, 58 bp, Artificial Sequence
  Description of Artificial Sequence: Synthetic oligonucleotide
aattcaaaaacgtggagatcttcggtacacactcgagtgtgtaccgaagatctccacg

SEQ ID NO: 2057 - DNA, 58 bp, Artificial Sequence
  Description of Artificial Sequence: Synthetic oligonucleotide
aattcaaaaagttggaggcctttagatattactcgagtaatatctaaaggcctccaac

SEQ ID NO: 2058 - DNA, 58 bp, Artificial Sequence
  Description of Artificial Sequence: Synthetic oligonucleotide
aattcaaaaaatgctcatatcaatcctataactcgagttataggattgatatgagcat

SEQ ID NO: 2059 - DNA, 58 bp, Artificial Sequence
  Description of Artificial Sequence: Synthetic oligonucleotide
aattcaaaaaacggttaggaagttgattattctcgagaataatcaacttcctaaccgt

SEQ ID NO: 2060 - DNA, 58 bp, Artificial Sequence
  Description of Artificial Sequence: Synthetic oligonucleotide
aattcaaaaacacactgcagtcggagctaatctcgagattagctccgactgcagtgtg

SEQ ID NO: 2061 - DNA, 58 bp, Artificial Sequence
  Description of Artificial Sequence: Synthetic oligonucleotide
aattcaaaaagaagccagaaattgtagattcctcgaggaatctacaatttctggcttc

SEQ ID NO: 2062 - DNA, 58 bp, Artificial Sequence
  Description of Artificial Sequence: Synthetic oligonucleotide
aattcaaaaatgctgatcctccctgagatagctcgagctatctcagggaggatcagca

SEQ ID NO: 2063 - DNA, 58 bp, Artificial Sequence
  Description of Artificial Sequence: Synthetic oligonucleotide
aattcaaaaagagttctgtgtggaagataaactcgagtttatcttccacacagaactc

SEQ ID NO: 2064 - DNA, 58 bp, Artificial Sequence
  Description of Artificial Sequence: Synthetic oligonucleotide
aattcaaaaagcgcacgtatgacagtgattgctcgagcaatcactgtcatacgtgcgc

SEQ ID NO: 2065 - DNA, 58 bp, Artificial Sequence
  Description of Artificial Sequence: Synthetic oligonucleotide
aattcaaaaaacgacggagtcacctacgaaactcgagtttcgtaggtgactccgtcgt

SEQ ID NO: 2066 - DNA, 58 bp, Artificial Sequence
  Description of Artificial Sequence: Synthetic oligonucleotide
aattcaaaaacggcatagagaccgacttaatctcgagattaagtcggtctctatgccg

SEQ ID NO: 2067 - DNA, 58 bp, Artificial Sequence
  Description of Artificial Sequence: Synthetic oligonucleotide
aattcaaaaagcggcatagagaccgacttaactcgagttaagtcggtctctatgccgc

SEQ ID NO: 2068 - DNA, 58 bp, Artificial Sequence
  Description of Artificial Sequence: Synthetic oligonucleotide
aattcaaaaaatccacagtcagccataataactcgagttattatggctgactgtggat

SEQ ID NO: 2069 - DNA, 58 bp, Artificial Sequence
  Description of Artificial Sequence: Synthetic oligonucleotide
aattcaaaaaactgcttaaagttggtattaactcgagttaataccaactttaagcagt

SEQ ID NO: 2070 - DNA, 58 bp, Artificial Sequence
  Description of Artificial Sequence: Synthetic oligonucleotide
aattcaaaaacagcctgatcttcacactaatctcgagattagtgtgaagatcaggctg

SEQ ID NO: 2071 - DNA, 58 bp, Artificial Sequence
  Description of Artificial Sequence: Synthetic oligonucleotide
aattcaaaaaagaagtagatgtcggagaaatctcgagatttctccgacatctacttct

SEQ ID NO: 2072 - DNA, 58 bp, Artificial Sequence
  Description of Artificial Sequence: Synthetic oligonucleotide
aattcaaaaagccagagtaaccctgactaatctcgagattagtcagggttactctggc

SEQ ID NO: 2073 - DNA, 58 bp, Artificial Sequence
  Description of Artificial Sequence: Synthetic oligonucleotide
aattcaaaaacctctttccagtggatcataactcgagttatgatccactggaaagagg

SEQ ID NO: 2074 - DNA, 58 bp, Artificial Sequence
  Description of Artificial Sequence: Synthetic oligonucleotide
aattcaaaaatactcggctcaggccattatgctcgagcataatggcctgagccgagta

SEQ ID NO: 2075 - DNA, 58 bp, Artificial Sequence
  Description of Artificial Sequence: Synthetic oligonucleotide
aattcaaaaaattcacggagaatgcaaatatctcgagatatttgcattctccgtgaat

SEQ ID NO: 2076 - DNA, 58 bp, Artificial Sequence
  Description of Artificial Sequence: Synthetic oligonucleotide
aattcaaaaatgtgccacagcaatatctattctcgagaatagatattgctgtggcaca

SEQ ID NO: 2077 - DNA, 58 bp, Artificial Sequence
  Description of Artificial Sequence: Synthetic oligonucleotide
aattcaaaaaactgcgttaaaggctcgatttctcgagaaatcgagcctttaacgcagt

SEQ ID NO: 2078 - DNA, 58 bp, Artificial Sequence
  Description of Artificial Sequence: Synthetic oligonucleotide
aattcaaaaaccggctcaataacatcgttaactcgagttaacgatgttattgagccgg

SEQ ID NO: 2079 - DNA, 58 bp, Artificial Sequence
  Description of Artificial Sequence: Synthetic oligonucleotide
aattcaaaaaacaagccagccggctcaataactcgagttattgagccggctggcttgt

SEQ ID NO: 2080 - DNA, 58 bp, Artificial Sequence
  Description of Artificial Sequence: Synthetic oligonucleotide
aattcaaaaaactgacgaggacagctatattctcgagaatatagctgtcctcgtcagt

SEQ ID NO: 2081 - DNA, 58 bp, Artificial Sequence
  Description of Artificial Sequence: Synthetic oligonucleotide
aattcaaaaagctcgtaagtcctccatcaaactcgagtttgatggaggacttacgagc

SEQ ID NO: 2082 - DNA, 58 bp, Artificial Sequence
  Description of Artificial Sequence: Synthetic oligonucleotide
aattcaaaaaacagctgtgcctacgactatcctcgaggatagtcgtaggcacagctgt

SEQ ID NO: 2083 - DNA, 58 bp, Artificial Sequence
  Description of Artificial Sequence: Synthetic oligonucleotide
aattcaaaaaagcaagacggtgtcgactttactcgagtaaagtcgacaccgtcttgct

SEQ ID NO: 2084 - DNA, 58 bp, Artificial Sequence
  Description of Artificial Sequence: Synthetic oligonucleotide
aattcaaaaagcgtcgtcacctacaagtttactcgagtaaacttgtaggtgacgacgc

SEQ ID NO: 2085 - DNA, 58 bp, Artificial Sequence
  Description of Artificial Sequence: Synthetic oligonucleotide
aattcaaaaacatggctgaacttaggctatactcgagtatagcctaagttcagccatg

SEQ ID NO: 2086 - DNA, 58 bp, Artificial Sequence
  Description of Artificial Sequence: Synthetic oligonucleotide
aattcaaaaatactacgcgatggtctcaattctcgagaattgagaccatcgcgtagta

SEQ ID NO: 2087 - DNA, 58 bp, Artificial Sequence
  Description of Artificial Sequence: Synthetic oligonucleotide
aattcaaaaagccttcttgttactctatttcctcgaggaaatagagtaacaagaaggc

SEQ ID NO: 2088 - DNA, 58 bp, Artificial Sequence
  Description of Artificial Sequence: Synthetic oligonucleotide
aattcaaaaaatggaacacagggcccaaatgctcgagcatttgggccctgtgttccat

SEQ ID NO: 2089 - DNA, 58 bp, Artificial Sequence
  Description of Artificial Sequence: Synthetic oligonucleotide
aattcaaaaagatcatctgaactccactaatctcgagattagtggagttcagatgatc

SEQ ID NO: 2090 - DNA, 58 bp, Artificial Sequence
  Description of Artificial Sequence: Synthetic oligonucleotide
aattcaaaaaccggagattcttctttaatttctcgagaaattaaagaagaatctccgg

SEQ ID NO: 2091 - DNA, 58 bp, Artificial Sequence
  Description of Artificial Sequence: Synthetic oligonucleotide
aattcaaaaacaagatgctttaggaaacaatctcgagattgtttcctaaagcatcttg

SEQ ID NO: 2092 - DNA, 58 bp, Artificial Sequence
  Description of Artificial Sequence: Synthetic oligonucleotide
aattcaaaaacttacagggacaccggaatttctcgagaaattccggtgtccctgtaag

SEQ ID NO: 2093 - DNA, 58 bp, Artificial Sequence
  Description of Artificial Sequence: Synthetic oligonucleotide
aattcaaaaaggccaaatctcatcgagatatctcgagatatctcgatgagatttggcc

SEQ ID NO: 2094 - DNA, 58 bp, Artificial Sequence
  Description of Artificial Sequence: Synthetic oligonucleotide
aattcaaaaagtggattgaacctcggaattgctcgagcaattccgaggttcaatccac

SEQ ID NO: 2095 - DNA, 58 bp, Artificial Sequence
  Description of Artificial Sequence: Synthetic oligonucleotide
aattcaaaaaccctggtcaattctgtcaattctcgagaattgacagaattgaccaggg

SEQ ID NO: 2096 - DNA, 58 bp, Artificial Sequence
  Description of Artificial Sequence: Synthetic oligonucleotide
aattcaaaaatccttgaggatagacagatatctcgagatatctgtctatcctcaagga

SEQ ID NO: 2097 - DNA, 58 bp, Artificial Sequence
  Description of Artificial Sequence: Synthetic oligonucleotide
aattcaaaaaagggccagcatgtcaggattactcgagtaatcctgacatgctggccct

SEQ ID NO: 2098 - DNA, 58 bp, Artificial Sequence
  Description of Artificial Sequence: Synthetic oligonucleotide
aattcaaaaatggacgcagtatcaacgtaaactcgagtttacgttgatactgcgtcca

SEQ ID NO: 2099 - DNA, 58 bp, Artificial Sequence
  Description of Artificial Sequence: Synthetic oligonucleotide
aattcaaaaaccagaaggatacgctgcatttctcgagaaatgcagcgtatccttctgg

SEQ ID NO: 2100 - DNA, 58 bp, Artificial Sequence
  Description of Artificial Sequence: Synthetic oligonucleotide
aattcaaaaaatgccaccaaccacgctatagctcgagctatagcgtggttggtggcat

SEQ ID NO: 2101 - DNA, 58 bp, Artificial Sequence
  Description of Artificial Sequence: Synthetic oligonucleotide
aattcaaaaaatacaggaatatggttgtaagctcgagcttacaaccatattcctgtat

SEQ ID NO: 2102 - DNA, 58 bp, Artificial Sequence
  Description of Artificial Sequence: Synthetic oligonucleotide
aattcaaaaacgccgacaacagagtcgtaatctcgagattacgactctgttgtcggcg

SEQ ID NO: 2103 - DNA, 58 bp, Artificial Sequence
  Description of Artificial Sequence: Synthetic oligonucleotide
aattcaaaaactgtctatcaaaggtagatttctcgagaaatctacctttgatagacag

SEQ ID NO: 2104 - DNA, 58 bp, Artificial Sequence
  Description of Artificial Sequence: Synthetic oligonucleotide
aattcaaaaaacgttccggatcagcgtttatctcgagataaacgctgatccggaacgt

SEQ ID NO: 2105 - DNA, 58 bp, Artificial Sequence
  Description of Artificial Sequence: Synthetic oligonucleotide
aattcaaaaaactcgtttccagaggtaattactcgagtaattacctctggaaacgagt

SEQ ID NO: 2106 - DNA, 58 bp, Artificial Sequence
  Description of Artificial Sequence: Synthetic oligonucleotide
aattcaaaaaaccatcgagagttccggtttgctcgagcaaaccggaactctcgatggt

SEQ ID NO: 2107 - DNA, 58 bp, Artificial Sequence
  Description of Artificial Sequence: Synthetic oligonucleotide
aattcaaaaaagggtgcagttagcatattagctcgagctaatatgctaactgcaccct

SEQ ID NO: 2108 - DNA, 58 bp, Artificial Sequence
  Description of Artificial Sequence: Synthetic oligonucleotide
aattcaaaaaagcacagaagtcctatcttagctcgagctaagataggacttctgtgct

SEQ ID NO: 2109 - DNA, 58 bp, Artificial Sequence
  Description of Artificial Sequence: Synthetic oligonucleotide
aattcaaaaaaggtacaacactggccatttcctcgaggaaatggccagtgttgtacct

SEQ ID NO: 2110 - DNA, 58 bp, Artificial Sequence
  Description of Artificial Sequence: Synthetic oligonucleotide
aattcaaaaaccaaggctactcggcctattactcgagtaataggccgagtagccttgg

SEQ ID NO: 2111 - DNA, 58 bp, Artificial Sequence
  Description of Artificial Sequence: Synthetic oligonucleotide
aattcaaaaagaccctcacaaccacgtacatctcgagatgtacgtggttgtgagggtc

SEQ ID NO: 2112 - DNA, 58 bp, Artificial Sequence
  Description of Artificial Sequence: Synthetic oligonucleotide
aattcaaaaacgttaacatggtggagcgagactcgagtctcgctccaccatgttaacg

SEQ ID NO: 2113 - DNA, 58 bp, Artificial Sequence
  Description of Artificial Sequence: Synthetic oligonucleotide
aattcaaaaagaacggctatgtgcgtttaaactcgagtttaaacgcacatagccgttc

SEQ ID NO: 2114 - DNA, 58 bp, Artificial Sequence
  Description of Artificial Sequence: Synthetic oligonucleotide
aattcaaaaagcctatggagtgaaattatttctcgagaaataatttcactccataggc

SEQ ID NO: 2115 - DNA, 58 bp, Artificial Sequence
  Description of Artificial Sequence: Synthetic oligonucleotide
aattcaaaaaattaccacgaggagatcattactcgagtaatgatctcctcgtggtaat

SEQ ID NO: 2116 - DNA, 58 bp, Artificial Sequence
  Description of Artificial Sequence: Synthetic oligonucleotide
aattcaaaaacatcatgtgaggctctgtaaactcgagtttacagagcctcacatgatg

SEQ ID NO: 2117 - DNA, 58 bp, Artificial Sequence
  Description of Artificial Sequence: Synthetic oligonucleotide
aattcaaaaacccaactcaacaaacctgaaactcgagtttcaggtttgttgagttggg

SEQ ID NO: 2118 - DNA, 58 bp, Artificial Sequence
  Description of Artificial Sequence: Synthetic oligonucleotide
aattcaaaaagccatcaactttcagagctatctcgagatagctctgaaagttgatggc

SEQ ID NO: 2119 - DNA, 58 bp, Artificial Sequence
  Description of Artificial Sequence: Synthetic oligonucleotide
aattcaaaaaacaccgagttcgtcaacattgctcgagcaatgttgacgaactcggtgt

SEQ ID NO: 2120 - DNA, 58 bp, Artificial Sequence
  Description of Artificial Sequence: Synthetic oligonucleotide
aattcaaaaagcgtaagacgctgtcggttaactcgagttaaccgacagcgtcttacgc

SEQ ID NO: 2121 - DNA, 58 bp, Artificial Sequence
  Description of Artificial Sequence: Synthetic oligonucleotide
aattcaaaaacgaggtgcaggccatgatttactcgagtaaatcatggcctgcacctcg

SEQ ID NO: 2122 - DNA, 58 bp, Artificial Sequence
  Description of Artificial Sequence: Synthetic oligonucleotide
aattcaaaaaacgatggagcctgcgttaatactcgagtattaacgcaggctccatcgt

SEQ ID NO: 2123 - DNA, 58 bp, Artificial Sequence
  Description of Artificial Sequence: Synthetic oligonucleotide
aattcaaaaatcccgacttctggtctattacctcgaggtaatagaccagaagtcggga

SEQ ID NO: 2124 - DNA, 58 bp, Artificial Sequence
  Description of Artificial Sequence: Synthetic oligonucleotide
aattcaaaaagcccgagagaacagcttatatctcgagatataagctgttctctcgggc

SEQ ID NO: 2125 - DNA, 58 bp, Artificial Sequence
  Description of Artificial Sequence: Synthetic oligonucleotide
aattcaaaaagcaatcctgtgttacagaaatctcgagatttctgtaacacaggattgc

SEQ ID NO: 2126 - DNA, 58 bp, Artificial Sequence
  Description of Artificial Sequence: Synthetic oligonucleotide
aattcaaaaactgctccaatgagggcttaatctcgagattaagccctcattggagcag

SEQ ID NO: 2127 - DNA, 58 bp, Artificial Sequence
  Description of Artificial Sequence: Synthetic oligonucleotide
aattcaaaaacctgagggcaatcctgtgttactcgagtaacacaggattgccctcagg

SEQ ID NO: 2128 - DNA, 58 bp, Artificial Sequence
  Description of Artificial Sequence: Synthetic oligonucleotide
aattcaaaaaccaactccaaagccataaatactcgagtatttatggctttggagttgg

SEQ ID NO: 2129 - DNA, 58 bp, Artificial Sequence
  Description of Artificial Sequence: Synthetic oligonucleotide
aattcaaaaacattctgaggtaacctcattactcgagtaatgaggttacctcagaatg

SEQ ID NO: 2130 - DNA, 58 bp, Artificial Sequence
  Description of Artificial Sequence: Synthetic oligonucleotide
aattcaaaaatcctccatgaatatcagttatctcgagataactgatattcatggagga

SEQ ID NO: 2131 - DNA, 58 bp, Artificial Sequence
  Description of Artificial Sequence: Synthetic oligonucleotide
aattcaaaaatggaatacttctaccataattctcgagaattatggtagaagtattcca

SEQ ID NO: 2132 - DNA, 58 bp, Artificial Sequence
  Description of Artificial Sequence: Synthetic oligonucleotide
aattcaaaaatcaagctggagtacgtgaaatctcgagatttcacgtactccagcttga

SEQ ID NO: 2133 - DNA, 58 bp, Artificial Sequence
  Description of Artificial Sequence: Synthetic oligonucleotide
aattcaaaaaactcaacgtcccatctacttgctcgagcaagtagatgggacgttgagt

SEQ ID NO: 2134 - DNA, 58 bp, Artificial Sequence
  Description of Artificial Sequence: Synthetic oligonucleotide
aattcaaaaacctagggaccaagactgaatcctcgaggattcagtcttggtccctagg

SEQ ID NO: 2135 - DNA, 58 bp, Artificial Sequence
  Description of Artificial Sequence: Synthetic oligonucleotide
aattcaaaaacagcggattatggattactatctcgagatagtaatccataatccgctg

SEQ ID NO: 2136 - DNA, 58 bp, Artificial Sequence
  Description of Artificial Sequence: Synthetic oligonucleotide
aattcaaaaacaagcccggaattgtcttcatctcgagatgaagacaattccgggcttg

SEQ ID NO: 2137 - DNA, 58 bp, Artificial Sequence
  Description of Artificial Sequence: Synthetic oligonucleotide
aattcaaaaagctgaagccctactcaatatactcgagtatattgagtagggcttcagc

SEQ ID NO: 2138 - DNA, 58 bp, Artificial Sequence
  Description of Artificial Sequence: Synthetic oligonucleotide
aattcaaaaaacagagttaatgatgtcaaagctcgagctttgacatcattaactctgt

SEQ ID NO: 2139 - DNA, 58 bp, Artificial Sequence
  Description of Artificial Sequence: Synthetic oligonucleotide
aattcaaaaaatcccgtgttcactcatgaaactcgagtttcatgagtgaacacgggat

SEQ ID NO: 2140 - DNA, 58 bp, Artificial Sequence
  Description of Artificial Sequence: Synthetic oligonucleotide
aattcaaaaaaggagaagtatttcgaatattctcgagaatattcgaaatacttctcct

SEQ ID NO: 2141 - DNA, 58 bp, Artificial Sequence
  Description of Artificial Sequence: Synthetic oligonucleotide
aattcaaaaaaggaacttgtccacggttaaactcgagtttaaccgtggacaagttcct

SEQ ID NO: 2142 - DNA, 58 bp, Artificial Sequence
  Description of Artificial Sequence: Synthetic oligonucleotide
aattcaaaaactgcctgaagtattatgagaactcgagttctcataatacttcaggcag

SEQ ID NO: 2143 - DNA, 58 bp, Artificial Sequence
  Description of Artificial Sequence: Synthetic oligonucleotide
aattcaaaaagagagtgaagaatgcagttaactcgagttaactgcattcttcactctc

SEQ ID NO: 2144 - DNA, 58 bp, Artificial Sequence
  Description of Artificial Sequence: Synthetic oligonucleotide
aattcaaaaagagtacttcaagggagccattctcgagaatggctcccttgaagtactc

SEQ ID NO: 2145 - DNA, 58 bp, Artificial Sequence
  Description of Artificial Sequence: Synthetic oligonucleotide
aattcaaaaagcaaagccttgagaggtcttgctcgagcaagacctctcaaggctttgc

SEQ ID NO: 2146 - DNA, 58 bp, Artificial Sequence
  Description of Artificial Sequence: Synthetic oligonucleotide
aattcaaaaatctattgttgagctgcattatctcgagataatgcagctcaacaataga

SEQ ID NO: 2147 - DNA, 58 bp, Artificial Sequence
  Description of Artificial Sequence: Synthetic oligonucleotide
aattcaaaaaccttcaactcttcgtacattcctcgaggaatgtacgaagagttgaagg

SEQ ID NO: 2148 - DNA, 58 bp, Artificial Sequence
  Description of Artificial Sequence: Synthetic oligonucleotide
aattcaaaaagtctatacctcctggcagattctcgagaatctgccaggaggtatagac

SEQ ID NO: 2149 - DNA, 58 bp, Artificial Sequence
  Description of Artificial Sequence: Synthetic oligonucleotide
aattcaaaaagagtcaagcattgtgaattatctcgagataattcacaatgcttgactc

SEQ ID NO: 2150 - DNA, 58 bp, Artificial Sequence
  Description of Artificial Sequence: Synthetic oligonucleotide
aattcaaaaagccgcagcagttaacctatgactcgagtcataggttaactgctgcggc

SEQ ID NO: 2151 - DNA, 58 bp, Artificial Sequence
  Description of Artificial Sequence: Synthetic oligonucleotide
aattcaaaaaccaactctgagtggcaccaatctcgagattggtgccactcagagttgg

SEQ ID NO: 2152 - DNA, 58 bp, Artificial Sequence
  Description of Artificial Sequence: Synthetic oligonucleotide
aattcaaaaacccagtcacctgctgttataactcgagttataacagcaggtgactggg

SEQ ID NO: 2153 - DNA, 58 bp, Artificial Sequence; identical to SEQ ID NO: 2152
  Description of Artificial Sequence: Synthetic oligonucleotide

SEQ ID NO: 2154 - DNA, 58 bp, Artificial Sequence
  Description of Artificial Sequence: Synthetic oligonucleotide
aattcaaaaagctcgcgagctatagaagaatctcgagattcttctatagctcgcgagc

SEQ ID NO: 2155 - DNA, 58 bp, Artificial Sequence
  Description of Artificial Sequence: Synthetic oligonucleotide
aattcaaaaaagttgtctgtgtgcgcaaatcctcgaggatttgcgcacacagacaact

SEQ ID NO: 2156 - DNA, 58 bp, Artificial Sequence
  Description of Artificial Sequence: Synthetic oligonucleotide
aattcaaaaagaccgtattcttcatcctaaactcgagtttaggatgaagaatacggtc

SEQ ID NO: 2157 - DNA, 58 bp, Artificial Sequence
  Description of Artificial Sequence: Synthetic oligonucleotide
aattcaaaaaagggtttagtgcttatctaatctcgagattagataagcactaaaccct

SEQ ID NO: 2158 - DNA, 58 bp, Artificial Sequence
  Description of Artificial Sequence: Synthetic oligonucleotide
aattcaaaaacactctttctcctgctttaacctcgaggttaaagcaggagaaagagtg

SEQ ID NO: 2159 - DNA, 58 bp, Artificial Sequence
  Description of Artificial Sequence: Synthetic oligonucleotide
aattcaaaaagagctatgtgcagacccaaagctcgagctttgggtctgcacatagctc

SEQ ID NO: 2160 - DNA, 58 bp, Artificial Sequence
  Description of Artificial Sequence: Synthetic oligonucleotide
aattcaaaaaccatcccagctatcctgttctctcgagagaacaggatagctgggatgg

SEQ ID NO: 2161 - DNA, 58 bp, Artificial Sequence
  Description of Artificial Sequence: Synthetic oligonucleotide
aattcaaaaaccctacctccctgccattatactcgagtataatggcagggaggtaggg

SEQ ID NO: 2162 - DNA, 58 bp, Artificial Sequence
  Description of Artificial Sequence: Synthetic oligonucleotide
aattcaaaaagcgtggtgaaacacttctactctcgagagtagaagtgtttcaccacgc

SEQ ID NO: 2163 - DNA, 58 bp, Artificial Sequence
  Description of Artificial Sequence: Synthetic oligonucleotide
aattcaaaaaatgttgctgacacccagaaagctcgagctttctgggtgtcagcaacat

SEQ ID NO: 2164 - DNA, 58 bp, Artificial Sequence
  Description of Artificial Sequence: Synthetic oligonucleotide
aattcaaaaacactcctggagagttactttgctcgagcaaagtaactctccaggagtg

SEQ ID NO: 2165 - DNA, 58 bp, Artificial Sequence
  Description of Artificial Sequence: Synthetic oligonucleotide
aattcaaaaacctttctcatgctgcaggattctcgagaatcctgcagcatgagaaagg

SEQ ID NO: 2166 - DNA, 58 bp, Artificial Sequence
  Description of Artificial Sequence: Synthetic oligonucleotide
aattcaaaaagaagctggacacacggatcaactcgagttgatccgtgtgtccagcttc

SEQ ID NO: 2167 - DNA, 58 bp, Artificial Sequence
  Description of Artificial Sequence: Synthetic oligonucleotide
aattcaaaaaagtgatcttcaccaccaagaactcgagttcttggtggtgaagatcact

SEQ ID NO: 2168 - DNA, 58 bp, Artificial Sequence
  Description of Artificial Sequence: Synthetic oligonucleotide
aattcaaaaagttctttgtttccaagagaatctcgagattctcttggaaacaaagaac

SEQ ID NO: 2169 - DNA, 58 bp, Artificial Sequence
  Description of Artificial Sequence: Synthetic oligonucleotide
aattcaaaaacctgctgcatgttctttgtttctcgagaaacaaagaacatgcagcagg

SEQ ID NO: 2170 - DNA, 58 bp, Artificial Sequence
  Description of Artificial Sequence: Synthetic oligonucleotide
aattcaaaaagccggatctttctccgataaactcgagtttatcggagaaagatccggc

SEQ ID NO: 2171 - DNA, 58 bp, Artificial Sequence
  Description of Artificial Sequence: Synthetic oligonucleotide
aattcaaaaagctcctggatgctcgaaataactcgagttatttcgagcatccaggagc

SEQ ID NO: 2172 - DNA, 58 bp, Artificial Sequence
  Description of Artificial Sequence: Synthetic oligonucleotide
aattcaaaaaccctcctgatatcagctaattctcgagaattagctgatatcaggaggg

SEQ ID NO: 2173 - DNA, 58 bp, Artificial Sequence
  Description of Artificial Sequence: Synthetic oligonucleotide
aattcaaaaacacacgtgggagtgacatatcctcgaggatatgtcactcccacgtgtg

SEQ ID NO: 2174 - DNA, 58 bp, Artificial Sequence
  Description of Artificial Sequence: Synthetic oligonucleotide
aattcaaaaatccgaaacaattgtgactcagctcgagctgagtcacaattgtttcgga

SEQ ID NO: 2175 - DNA, 58 bp, Artificial Sequence
  Description of Artificial Sequence: Synthetic oligonucleotide
aattcaaaaagctgtgatattcactaccaaactcgagtttggtagtgaatatcacagc

SEQ ID NO: 2176 - DNA, 58 bp, Artificial Sequence
  Description of Artificial Sequence: Synthetic oligonucleotide
aattcaaaaattcgtgcttcacctggctcaactcgagttgagccaggtgaagcacgaa

SEQ ID NO: 2177 - DNA, 58 bp, Artificial Sequence
  Description of Artificial Sequence: Synthetic oligonucleotide
aattcaaaaaccgaaagccactctcagacaactcgagttgtctgagagtggctttcgg

SEQ ID NO: 2178 - DNA, 58 bp, Artificial Sequence
  Description of Artificial Sequence: Synthetic oligonucleotide
aattcaaaaacaagctactgaggaaggtcatctcgagatgaccttcctcagtagcttg

SEQ ID NO: 2179 - DNA, 58 bp, Artificial Sequence
  Description of Artificial Sequence: Synthetic oligonucleotide
aattcaaaaacggaggtttcacatcatatttctcgagaaatatgatgtgaaacctccg

SEQ ID NO: 2180 - DNA, 58 bp, Artificial Sequence
  Description of Artificial Sequence: Synthetic oligonucleotide
aattcaaaaacacgaaacatacggccataaactcgagtttatggccgtatgtttcgtg

SEQ ID NO: 2181 - DNA, 58 bp, Artificial Sequence
  Description of Artificial Sequence: Synthetic oligonucleotide
aattcaaaaattagagagtctacagataaatctcgagatttatctgtagactctctaa

SEQ ID NO: 2182 - DNA, 58 bp, Artificial Sequence
  Description of Artificial Sequence: Synthetic oligonucleotide
aattcaaaaaccggcagattccacagaatttctcgagaaattctgtggaatctgccgg

SEQ ID NO: 2183 - DNA, 58 bp, Artificial Sequence
  Description of Artificial Sequence: Synthetic oligonucleotide
aattcaaaaattcgatttcacagtgtgtttgctcgagcaaacacactgtgaaatcgaa

SEQ ID NO: 2184 - DNA, 58 bp, Artificial Sequence
  Description of Artificial Sequence: Synthetic oligonucleotide
aattcaaaaacaaccagttctctgcatcactctcgagagtgatgcagagaactggttg

SEQ ID NO: 2185 - DNA, 58 bp, Artificial Sequence
  Description of Artificial Sequence: Synthetic oligonucleotide
aattcaaaaaatgtgccgtgttattgtattactcgagtaatacaataacacggcacat

SEQ ID NO: 2186 - DNA, 58 bp, Artificial Sequence
  Description of Artificial Sequence: Synthetic oligonucleotide
aattcaaaaatcctgtcccttctcttaatttctcgagaaattaagagaagggacagga

SEQ ID NO: 2187 - DNA, 58 bp, Artificial Sequence
  Description of Artificial Sequence: Synthetic oligonucleotide
aattcaaaaactgtgctgatcccagtgaatcctcgaggattcactgggatcagcacag

SEQ ID NO: 2188 - DNA, 58 bp, Artificial Sequence
  Description of Artificial Sequence: Synthetic oligonucleotide
aattcaaaaatgaacctgaacttacacaaatctcgagatttgtgtaagttcaggttca

SEQ ID NO: 2189 - DNA, 58 bp, Artificial Sequence
  Description of Artificial Sequence: Synthetic oligonucleotide
aattcaaaaacctgctgctttgcctacattgctcgagcaatgtaggcaaagcagcagg

SEQ ID NO: 2190 - DNA, 58 bp, Artificial Sequence
  Description of Artificial Sequence: Synthetic oligonucleotide
aattcaaaaactaccacacagcagcagttacctcgaggtaactgctgctgtgtggtag

SEQ ID NO: 2191 - DNA, 58 bp, Artificial Sequence
  Description of Artificial Sequence: Synthetic oligonucleotide
aattcaaaaacataaagccttggatgtatatctcgagatatacatccaaggctttatg

SEQ ID NO: 2192 - DNA, 58 bp, Artificial Sequence
  Description of Artificial Sequence: Synthetic oligonucleotide
aattcaaaaagctgctacagatttatcaatactcgagtattgataaatctgtagcagc

SEQ ID NO: 2193 - DNA, 58 bp, Artificial Sequence
  Description of Artificial Sequence: Synthetic oligonucleotide
aattcaaaaatctaaggaatatgagctttatctcgagataaagctcatattccttaga

SEQ ID NO: 2194 - DNA, 58 bp, Artificial Sequence
  Description of Artificial Sequence: Synthetic oligonucleotide
aattcaaaaagctgctttaacgtgatcaatactcgagtattgatcacgttaaagcagc

SEQ ID NO: 2195 - DNA, 58 bp, Artificial Sequence
  Description of Artificial Sequence: Synthetic oligonucleotide
aattcaaaaacaggtgcagtgtgacattattctcgagaataatgtcacactgcacctg

SEQ ID NO: 2196 - DNA, 58 bp, Artificial Sequence
  Description of Artificial Sequence: Synthetic oligonucleotide
aattcaaaaattgtactgctgttgttgaaatctcgagatttcaacaacagcagtacaa

SEQ ID NO: 2197 - DNA, 58 bp, Artificial Sequence
  Description of Artificial Sequence: Synthetic oligonucleotide
aattcaaaaaattctgctaagacgaccaaatctcgagatttggtcgtcttagcagaat

SEQ ID NO: 2198 - DNA, 58 bp, Artificial Sequence
  Description of Artificial Sequence: Synthetic oligonucleotide
aattcaaaaaatctgctacacagggattatactcgagtataatccctgtgtagcagat

SEQ ID NO: 2199 - DNA, 58 bp, Artificial Sequence
  Description of Artificial Sequence: Synthetic oligonucleotide
aattcaaaaacctctgtactccttggtatttctcgagaaataccaaggagtacagagg

SEQ ID NO: 2200 - DNA, 58 bp, Artificial Sequence
  Description of Artificial Sequence: Synthetic oligonucleotide
aattcaaaaaacggtgctccctgtcataaatctcgagatttatgacagggagcaccgt

SEQ ID NO: 2201 - DNA, 58 bp, Artificial Sequence
  Description of Artificial Sequence: Synthetic oligonucleotide
aattcaaaaacttctggactccctataatatctcgagatattatagggagtccagaag

SEQ ID NO: 2202 - DNA, 58 bp, Artificial Sequence
  Description of Artificial Sequence: Synthetic oligonucleotide
aattcaaaaagctgtatcacatcggttatttctcgagaaataaccgatgtgatacagc

SEQ ID NO: 2203 - DNA, 58 bp, Artificial Sequence
  Description of Artificial Sequence: Synthetic oligonucleotide
aattcaaaaaatacaggaggctccgaattatctcgagataattcggagcctcctgtat

SEQ ID NO: 2204 - DNA, 58 bp, Artificial Sequence
  Description of Artificial Sequence: Synthetic oligonucleotide
aattcaaaaacccagaggatacagtatatagctcgagctatatactgtatcctctggg

SEQ ID NO: 2205 - DNA, 58 bp, Artificial Sequence
  Description of Artificial Sequence: Synthetic oligonucleotide
aattcaaaaatagcagctcttcctgaatttactcgagtaaattcaggaagagctgcta

SEQ ID NO: 2206 - DNA, 58 bp, Artificial Sequence
  Description of Artificial Sequence: Synthetic oligonucleotide
aattcaaaaaactcttgacagggctctatttctcgagaaatagagccctgtcaagagt

SEQ ID NO: 2207 - DNA, 58 bp, Artificial Sequence
  Description of Artificial Sequence: Synthetic oligonucleotide
aattcaaaaacgagcgagcaagctcagtttactcgagtaaactgagcttgctcgctcg

SEQ ID NO: 2208 - DNA, 58 bp, Artificial Sequence
  Description of Artificial Sequence: Synthetic oligonucleotide
aattcaaaaatccatacagtcagtatcaattctcgagaattgatactgactgtatgga

SEQ ID NO: 2209 - DNA, 58 bp, Artificial Sequence
  Description of Artificial Sequence: Synthetic oligonucleotide
aattcaaaaaggtctatgacagacgtctatcctcgaggatagacgtctgtcatagacc

SEQ ID NO: 2210 - DNA, 58 bp, Artificial Sequence
  Description of Artificial Sequence: Synthetic oligonucleotide
aattcaaaaacgactccagtgaagattatttctcgagaaataatcttcactggagtcg

SEQ ID NO: 2211 - DNA, 58 bp, Artificial Sequence
  Description of Artificial Sequence: Synthetic oligonucleotide
aattcaaaaatcgactccagtgaagattattctcgagaataatcttcactggagtcga

SEQ ID NO: 2212 - DNA, 58 bp, Artificial Sequence
  Description of Artificial Sequence: Synthetic oligonucleotide
aattcaaaaagatgaggtcacggacgattacctcgaggtaatcgtccgtgacctcatc

SEQ ID NO: 2213 - DNA, 58 bp, Artificial Sequence
  Description of Artificial Sequence: Synthetic oligonucleotide
aattcaaaaagctggtcgtgttgacctatatctcgagatataggtcaacacgaccagc

SEQ ID NO: 2214 - DNA, 58 bp, Artificial Sequence
  Description of Artificial Sequence: Synthetic oligonucleotide
aattcaaaaacgtgttgacctatatctatttctcgagaaatagatataggtcaacacg

SEQ ID NO: 2215 - DNA, 58 bp, Artificial Sequence
  Description of Artificial Sequence: Synthetic oligonucleotide
aattcaaaaagccgatccttacatagatattctcgagaatatctatgtaaggatcggc

SEQ ID NO: 2216 - DNA, 58 bp, Artificial Sequence
  Description of Artificial Sequence: Synthetic oligonucleotide
aattcaaaaacccggaggaaatgtgactattctcgagaatagtcacatttcctccggg

SEQ ID NO: 2217 - DNA, 58 bp, Artificial Sequence
  Description of Artificial Sequence: Synthetic oligonucleotide
aattcaaaaaccgcttatcatttgagaccaactcgagttggtctcaaatgataagcgg

SEQ ID NO: 2218 - DNA, 58 bp, Artificial Sequence
  Description of Artificial Sequence: Synthetic oligonucleotide
aattcaaaaacttaccttatgtcagtgagatctcgagatctcactgacataaggtaag

SEQ ID NO: 2219 - DNA, 58 bp, Artificial Sequence
  Description of Artificial Sequence: Synthetic oligonucleotide
aattcaaaaagcactgtaactctggtcttctctcgagagaagaccagagttacagtgc

SEQ ID NO: 2220 - DNA, 58 bp, Artificial Sequence
  Description of Artificial Sequence: Synthetic oligonucleotide
aattcaaaaaccacccacttaccttatgtcactcgagtgacataaggtaagtgggtgg

SEQ ID NO: 2221 - DNA, 58 bp, Artificial Sequence
  Description of Artificial Sequence: Synthetic oligonucleotide
aattcaaaaagccagatgtgtgagccaggaactcgagttcctggctcacacatctggc

SEQ ID NO: 2222 - DNA, 58 bp, Artificial Sequence
  Description of Artificial Sequence: Synthetic oligonucleotide
aattcaaaaacctccagaatttgtatgttaactcgagttaacatacaaattctggagg

SEQ ID NO: 2223 - DNA, 58 bp, Artificial Sequence
  Description of Artificial Sequence: Synthetic oligonucleotide
aattcaaaaacaaccttagctgcaagtattcctcgaggaatacttgcagctaaggttg

SEQ ID NO: 2224 - DNA, 58 bp, Artificial Sequence
  Description of Artificial Sequence: Synthetic oligonucleotide
aattcaaaaatggagtcctggcttgctatagctcgagctatagcaagccaggactcca

SEQ ID NO: 2225 - DNA, 58 bp, Artificial Sequence
  Description of Artificial Sequence: Synthetic oligonucleotide
aattcaaaaacctcctccttacctagacaatctcgagattgtctaggtaaggaggagg

SEQ ID NO: 2226 - DNA, 58 bp, Artificial Sequence
  Description of Artificial Sequence: Synthetic oligonucleotide
aattcaaaaaagaacctattgatggattaaactcgagtttaatccatcaataggttct

SEQ ID NO: 2227 - DNA, 58 bp, Artificial Sequence
  Description of Artificial Sequence: Synthetic oligonucleotide
aattcaaaaagccataatcgacacatataaactcgagtttatatgtgtcgattatggc

SEQ ID NO: 2228 - DNA, 58 bp, Artificial Sequence
  Description of Artificial Sequence: Synthetic oligonucleotide
aattcaaaaaacggctgcaggtcaacctattctcgagaataggttgacctgcagccgt

SEQ ID NO: 2229 - DNA, 58 bp, Artificial Sequence
  Description of Artificial Sequence: Synthetic oligonucleotide
aattcaaaaacctgatcatcaagaatcttaactcgagttaagattcttgatgatcagg

SEQ ID NO: 2230 - DNA, 58 bp, Artificial Sequence
  Description of Artificial Sequence: Synthetic oligonucleotide
aattcaaaaaagagcggatgtctcagatcaactcgagttgatctgagacatccgctct

SEQ ID NO: 2231 - DNA, 58 bp, Artificial Sequence
  Description of Artificial Sequence: Synthetic oligonucleotide
aattcaaaaaccactcgcctttacagttgaactcgagttcaactgtaaaggcgagtgg

SEQ ID NO: 2232 - DNA, 58 bp, Artificial Sequence
  Description of Artificial Sequence: Synthetic oligonucleotide
aattcaaaaagggaaacagctgaccgttaaactcgagtttaacggtcagctgtttccc

SEQ ID NO: 2233 - DNA, 58 bp, Artificial Sequence
  Description of Artificial Sequence: Synthetic oligonucleotide
aattcaaaaattcgagtcaagctccatttatctcgagataaatggagcttgactcgaa

SEQ ID NO: 2234 - DNA, 58 bp, Artificial Sequence
  Description of Artificial Sequence: Synthetic oligonucleotide
aattcaaaaatgacgctgggagtcttcataactcgagttatgaagactcccagcgtca

SEQ ID NO: 2235 - DNA, 58 bp, Artificial Sequence
  Description of Artificial Sequence: Synthetic oligonucleotide
aattcaaaaaccatcgtgatggcatctacatctcgagatgtagatgccatcacgatgg

SEQ ID NO: 2236 - DNA, 58 bp, Artificial Sequence
  Description of Artificial Sequence: Synthetic oligonucleotide
aattcaaaaacagctacgtatccatcgtgatctcgagatcacgatggatacgtagctg

SEQ ID NO: 2237 - DNA, 58 bp, Artificial Sequence
  Description of Artificial Sequence: Synthetic oligonucleotide
aattcaaaaaccaacctcactgggacactttctcgagaaagtgtcccagtgaggttgg

SEQ ID NO: 2238 - DNA, 58 bp, Artificial Sequence
  Description of Artificial Sequence: Synthetic oligonucleotide
aattcaaaaacaagtcggaacagcagataacctcgaggttatctgctgttccgacttg

SEQ ID NO: 2239 - DNA, 58 bp, Artificial Sequence
  Description of Artificial Sequence: Synthetic oligonucleotide
aattcaaaaagagaacctgagacaccttaagctcgagcttaaggtgtctcaggttctc

SEQ ID NO: 2240 - DNA, 58 bp, Artificial Sequence
  Description of Artificial Sequence: Synthetic oligonucleotide
aattcaaaaaccacacagctacagctttcttctcgagaagaaagctgtagctgtgtgg

SEQ ID NO: 2241 - DNA, 58 bp, Artificial Sequence
  Description of Artificial Sequence: Synthetic oligonucleotide
aattcaaaaagctggacttcgcctgtgatatctcgagatatcacaggcgaagtccagc

SEQ ID NO: 2242 - DNA, 58 bp, Artificial Sequence
  Description of Artificial Sequence: Synthetic oligonucleotide
aattcaaaaagtgtattcattctcatgattactcgagtaatcatgagaatgaatacac

SEQ ID NO: 2243 - DNA, 58 bp, Artificial Sequence
  Description of Artificial Sequence: Synthetic oligonucleotide
aattcaaaaaccagagacagcttgatcaaagctcgagctttgatcaagctgtctctgg

SEQ ID NO: 2244 - DNA, 58 bp, Artificial Sequence
  Description of Artificial Sequence: Synthetic oligonucleotide
aattcaaaaaccttctcctgtcactggttatctcgagataaccagtgacaggagaagg

SEQ ID NO: 2245 - DNA, 58 bp, Artificial Sequence
  Description of Artificial Sequence: Synthetic oligonucleotide
aattcaaaaagagaagatgctgtccagatttctcgagaaatctggacagcatcttctc

SEQ ID NO: 2246 - DNA, 58 bp, Artificial Sequence
  Description of Artificial Sequence: Synthetic oligonucleotide
aattcaaaaaccagccgatagatggaatgaactcgagttcattccatctatcggctgg

SEQ ID NO: 2247 - DNA, 58 bp, Artificial Sequence
  Description of Artificial Sequence: Synthetic oligonucleotide
aattcaaaaacaagaaattctggcaccacttctcgagaagtggtgccagaatttcttg

SEQ ID NO: 2248 - DNA, 58 bp, Artificial Sequence
  Description of Artificial Sequence: Synthetic oligonucleotide
aattcaaaaaacgtcctgcaaagtgtcctttctcgagaaaggacactttgcaggacgt

SEQ ID NO: 2249 - DNA, 58 bp, Artificial Sequence
  Description of Artificial Sequence: Synthetic oligonucleotide
aattcaaaaaactgatccagagctggagaaactcgagtttctccagctctggatcagt

SEQ ID NO: 2250 - DNA, 58 bp, Artificial Sequence
  Description of Artificial Sequence: Synthetic oligonucleotide
aattcaaaaacggctgctgaagggattctatctcgagatagaatcccttcagcagccg

SEQ ID NO: 2251 - DNA, 58 bp, Artificial Sequence
  Description of Artificial Sequence: Synthetic oligonucleotide
aattcaaaaacctttgcttgtgtttgcacttctcgagaagtgcaaacacaagcaaagg

SEQ ID NO: 2252 - DNA, 58 bp, Artificial Sequence
  Description of Artificial Sequence: Synthetic oligonucleotide
aattcaaaaaccctgaaccatatattgttatctcgagataacaatatatggttcaggg

SEQ ID NO: 2253 - DNA, 58 bp, Artificial Sequence
  Description of Artificial Sequence: Synthetic oligonucleotide
aattcaaaaatggatttgaagtcaccgttatctcgagataacggtgacttcaaatcca

SEQ ID NO: 2254 - DNA, 58 bp, Artificial Sequence
  Description of Artificial Sequence: Synthetic oligonucleotide
aattcaaaaagaaacaaacatggtggcaattctcgagaattgccaccatgtttgtttc

SEQ ID NO: 2255 - DNA, 58 bp, Artificial Sequence
  Description of Artificial Sequence: Synthetic oligonucleotide
aattcaaaaaccacaggatttcctgaaagttctcgagaactttcaggaaatcctgtgg

SEQ ID NO: 2256 - DNA, 58 bp, Artificial Sequence
  Description of Artificial Sequence: Synthetic oligonucleotide
aattcaaaaacatggtggcaattctacacaactcgagttgtgtagaattgccaccatg

SEQ ID NO: 2257 - DNA, 58 bp, Artificial Sequence
  Description of Artificial Sequence: Synthetic oligonucleotide
aattcaaaaacaccacttgctgacctatttactcgagtaaataggtcagcaagtggtg

SEQ ID NO: 2258 - DNA, 58 bp, Artificial Sequence
  Description of Artificial Sequence: Synthetic oligonucleotide
aattcaaaaagacctatttacattggcccttctcgagaagggccaatgtaaataggtc

SEQ ID NO: 2259 - DNA, 58 bp, Artificial Sequence
  Description of Artificial Sequence: Synthetic oligonucleotide
aattcaaaaagctgtgttcctttcagtagttctcgagaactactgaaaggaacacagc

SEQ ID NO: 2260 - DNA, 58 bp, Artificial Sequence
  Description of Artificial Sequence: Synthetic oligonucleotide
aattcaaaaagtaaggagccatcggacaaacctcgaggtttgtccgatggctccttac

SEQ ID NO: 2261 - DNA, 58 bp, Artificial Sequence
  Description of Artificial Sequence: Synthetic oligonucleotide
aattcaaaaacttacttgctgtgatccttatctcgagataaggatcacagcaagtaag

SEQ ID NO: 2262 - DNA, 58 bp, Artificial Sequence
  Description of Artificial Sequence: Synthetic oligonucleotide
aattcaaaaacataaggagccatcggacaaactcgagtttgtccgatggctccttatg

SEQ ID NO: 2263 - DNA, 58 bp, Artificial Sequence
  Description of Artificial Sequence: Synthetic oligonucleotide
aattcaaaaacatcgtgtttgcaactgatttctcgagaaatcagttgcaaacacgatg

SEQ ID NO: 2264 - DNA, 58 bp, Artificial Sequence
  Description of Artificial Sequence: Synthetic oligonucleotide
aattcaaaaagcttcttaacagatggcatttctcgagaaatgccatctgttaagaagc

SEQ ID NO: 2265 - DNA, 58 bp, Artificial Sequence; identical to SEQ ID NO: 2264
  Description of Artificial Sequence: Synthetic oligonucleotide

SEQ ID NO: 2266 - DNA, 58 bp, Artificial Sequence
  Description of Artificial Sequence: Synthetic oligonucleotide
aattcaaaaacaactggaatctgacagatttctcgagaaatctgtcagattccagttg

SEQ ID NO: 2267 - DNA, 58 bp, Artificial Sequence
  Description of Artificial Sequence: Synthetic oligonucleotide
aattcaaaaagactggcgtcttgctgattatctcgagataatcagcaagacgccagtc

SEQ ID NO: 2268 - DNA, 58 bp, Artificial Sequence
  Description of Artificial Sequence: Synthetic oligonucleotide
aattcaaaaagcagaaattgctgccgtgatactcgagtatcacggcagcaatttctgc

SEQ ID NO: 2269 - DNA, 58 bp, Artificial Sequence
  Description of Artificial Sequence: Synthetic oligonucleotide
aattcaaaaacaagatctaccggactgagatctcgagatctcagtccggtagatcttg

SEQ ID NO: 2270 - DNA, 58 bp, Artificial Sequence
  Description of Artificial Sequence: Synthetic oligonucleotide
aattcaaaaacctgaccctcatcatcttcatctcgagatgaagatgatgagggtcagg

SEQ ID NO: 2271 - DNA, 58 bp, Artificial Sequence
  Description of Artificial Sequence: Synthetic oligonucleotide
aattcaaaaacttcctctatgccacccagtactcgagtactgggtggcatagaggaag

SEQ ID NO: 2272 - DNA, 58 bp, Artificial Sequence
  Description of Artificial Sequence: Synthetic oligonucleotide
aattcaaaaagccctcactgagccacttaatctcgagattaagtggctcagtgagggc

SEQ ID NO: 2273 - DNA, 58 bp, Artificial Sequence
  Description of Artificial Sequence: Synthetic oligonucleotide
aattcaaaaacccaagacagtgaaagtaattctcgagaattactttcactgtcttggg

SEQ ID NO: 2274 - DNA, 58 bp, Artificial Sequence; identical to SEQ ID NO: 2273
  Description of Artificial Sequence: Synthetic oligonucleotide

SEQ ID NO: 2275 - DNA, 58 bp, Artificial Sequence
  Description of Artificial Sequence: Synthetic oligonucleotide
aattcaaaaactgctgaaagtggcgcaaatgctcgagcatttgcgccactttcagcag

SEQ ID NO: 2276 - DNA, 58 bp, Artificial Sequence
  Description of Artificial Sequence: Synthetic oligonucleotide
aattcaaaaacaaagccctgtcctaatttatctcgagataaattaggacagggctttg

SEQ ID NO: 2277 - DNA, 58 bp, Artificial Sequence
  Description of Artificial Sequence: Synthetic oligonucleotide
aattcaaaaacctgtcgatctttggtttcatctcgagatgaaaccaaagatcgacagg

SEQ ID NO: 2278 - DNA, 58 bp, Artificial Sequence
  Description of Artificial Sequence: Synthetic oligonucleotide
aattcaaaaatgctggtatggacgcttattgctcgagcaataagcgtccataccagca

SEQ ID NO: 2279 - DNA, 58 bp, Artificial Sequence
  Description of Artificial Sequence: Synthetic oligonucleotide
aattcaaaaagcaaagtgttgtagcttataactcgagttataagctacaacactttgc

SEQ ID NO: 2280 - DNA, 58 bp, Artificial Sequence
  Description of Artificial Sequence: Synthetic oligonucleotide
aattcaaaaaatattcccagagaattgtattctcgagaatacaattctctgggaatat

SEQ ID NO: 2281 - DNA, 58 bp, Artificial Sequence
  Description of Artificial Sequence: Synthetic oligonucleotide
aattcaaaaagtaacctctacaggcatttaactcgagttaaatgcctgtagaggttac

SEQ ID NO: 2282 - DNA, 58 bp, Artificial Sequence
  Description of Artificial Sequence: Synthetic oligonucleotide
aattcaaaaagttgaaggactacaggtatttctcgagaaatacctgtagtccttcaac

SEQ ID NO: 2283 - DNA, 58 bp, Artificial Sequence
  Description of Artificial Sequence: Synthetic oligonucleotide
aattcaaaaaggtgacttccatcaagctatactcgagtatagcttgatggaagtcacc

SEQ ID NO: 2284 - DNA, 58 bp, Artificial Sequence
  Description of Artificial Sequence: Synthetic oligonucleotide
aattcaaaaacattctcttcagacacaatttctcgagaaattgtgtctgaagagaatg

SEQ ID NO: 2285 - DNA, 58 bp, Artificial Sequence
  Description of Artificial Sequence: Synthetic oligonucleotide
aattcaaaaagcattctcttcagacacaattctcgagaattgtgtctgaagagaatgc

SEQ ID NO: 2286 - DNA, 58 bp, Artificial Sequence
  Description of Artificial Sequence: Synthetic oligonucleotide
aattcaaaaagccgggaaggagtacattatcctcgaggataatgtactccttcccggc

SEQ ID NO: 2287 - DNA, 58 bp, Artificial Sequence
  Description of Artificial Sequence: Synthetic oligonucleotide
aattcaaaaactaaggatcaccattactttactcgagtaaagtaatggtgatccttag

SEQ ID NO: 2288 - DNA, 58 bp, Artificial Sequence
  Description of Artificial Sequence: Synthetic oligonucleotide
aattcaaaaaccagactattccacttaataactcgagttattaagtggaatagtctgg

SEQ ID NO: 2289 - DNA, 58 bp, Artificial Sequence
  Description of Artificial Sequence: Synthetic oligonucleotide
aattcaaaaacagtctctgagaagtactttactcgagtaaagtacttctcagagactg

SEQ ID NO: 2290 - DNA, 58 bp, Artificial Sequence
  Description of Artificial Sequence: Synthetic oligonucleotide
aattcaaaaacgatgtactcacgctggatatctcgagatatccagcgtgagtacatcg

SEQ ID NO: 2291 - DNA, 58 bp, Artificial Sequence; identical to SEQ ID NO: 2290
  Description of Artificial Sequence: Synthetic oligonucleotide

SEQ ID NO: 2292 - DNA, 58 bp, Artificial Sequence
  Description of Artificial Sequence: Synthetic oligonucleotide
aattcaaaaacccagagaaacccgtcaacatctcgagatgttgacgggtttctctggg

SEQ ID NO: 2293 - DNA, 58 bp, Artificial Sequence
  Description of Artificial Sequence: Synthetic oligonucleotide
aattcaaaaatctcctggtacaagacataatctcgagattatgtcttgtaccaggaga

SEQ ID NO: 2294 - DNA, 58 bp, Artificial Sequence
  Description of Artificial Sequence: Synthetic oligonucleotide
aattcaaaaagtcggcctgatttcccgtaaactcgagtttacgggaaatcaggccgac

SEQ ID NO: 2295 - DNA, 58 bp, Artificial Sequence
  Description of Artificial Sequence: Synthetic oligonucleotide
aattcaaaaattgacaaggactggaatatttctcgagaaatattccagtccttgtcaa

SEQ ID NO: 2296 - DNA, 58 bp, Artificial Sequence
  Description of Artificial Sequence: Synthetic oligonucleotide
aattcaaaaagtgaacagcaagttctataaactcgagtttatagaacttgctgttcac

SEQ ID NO: 2297 - DNA, 58 bp, Artificial Sequence
  Description of Artificial Sequence: Synthetic oligonucleotide
aattcaaaaaacaggagagagcgggactatactcgagtatagtcccgctctctcctgt

SEQ ID NO: 2298 - DNA, 58 bp, Artificial Sequence
  Description of Artificial Sequence: Synthetic oligonucleotide
aattcaaaaagctgctattgtacaagtataactcgagttatacttgtacaatagcagc

SEQ ID NO: 2299 - DNA, 58 bp, Artificial Sequence
  Description of Artificial Sequence: Synthetic oligonucleotide
aattcaaaaaggagctgctctctcatgaaacctcgaggtttcatgagagagcagctcc

SEQ ID NO: 2300 - DNA, 58 bp, Artificial Sequence
  Description of Artificial Sequence: Synthetic oligonucleotide
aattcaaaaacccagattatcacctttgaaactcgagtttcaaaggtgataatctggg

SEQ ID NO: 2301 - DNA, 58 bp, Artificial Sequence
  Description of Artificial Sequence: Synthetic oligonucleotide
aattcaaaaagaagtcatctcagaaatgtttctcgagaaacatttctgagatgacttc

SEQ ID NO: 2302 - DNA, 58 bp, Artificial Sequence
  Description of Artificial Sequence: Synthetic oligonucleotide
aattcaaaaagtctatttaagcctcatatttctcgagaaatatgaggcttaaatagac

SEQ ID NO: 2303 - DNA, 58 bp, Artificial Sequence
  Description of Artificial Sequence: Synthetic oligonucleotide
aattcaaaaagataggtaaataccaagtattctcgagaatacttggtatttacctatc

SEQ ID NO: 2304 - DNA, 58 bp, Artificial Sequence
  Description of Artificial Sequence: Synthetic oligonucleotide
aattcaaaaagcttagagcaagtgaggaagactcgagtcttcctcacttgctctaagc

SEQ ID NO: 2305 - DNA, 58 bp, Artificial Sequence
  Description of Artificial Sequence: Synthetic oligonucleotide
aattcaaaaacagccaggcctgcacataaatctcgagatttatgtgcaggcctggctg

SEQ ID NO: 2306 - DNA, 58 bp, Artificial Sequence
  Description of Artificial Sequence: Synthetic oligonucleotide
aattcaaaaactatgcctactctcaagaaatctcgagatttcttgagagtaggcatag

SEQ ID NO: 2307 - DNA, 58 bp, Artificial Sequence
  Description of Artificial Sequence: Synthetic oligonucleotide
aattcaaaaaccagcttcactctgaagagttctcgagaactcttcagagtgaagctgg

SEQ ID NO: 2308 - DNA, 58 bp, Artificial Sequence
  Description of Artificial Sequence: Synthetic oligonucleotide
aattcaaaaagagcagctgctccaggaatatctcgagatattcctggagcagctgctc

SEQ ID NO: 2309 - DNA, 58 bp, Artificial Sequence
  Description of Artificial Sequence: Synthetic oligonucleotide
aattcaaaaagtctctccttccgcttctttgctcgagcaaagaagcggaaggagagac

SEQ ID NO: 2310 - DNA, 58 bp, Artificial Sequence
  Description of Artificial Sequence: Synthetic oligonucleotide
aattcaaaaatgtctgtctgtctgctcttagctcgagctaagagcagacagacagaca

SEQ ID NO: 2311 - DNA, 58 bp, Artificial Sequence
  Description of Artificial Sequence: Synthetic oligonucleotide
aattcaaaaacccggagctgtggtagtaattctcgagaattactaccacagctccggg

SEQ ID NO: 2312 - DNA, 58 bp, Artificial Sequence
  Description of Artificial Sequence: Synthetic oligonucleotide
aattcaaaaagctgctgccctaactcgaaatctcgagatttcgagttagggcagcagc

SEQ ID NO: 2313 - DNA, 58 bp, Artificial Sequence
  Description of Artificial Sequence: Synthetic oligonucleotide
aattcaaaaacggtgtgacgaaatgcaacatctcgagatgttgcatttcgtcacaccg

SEQ ID NO: 2314 - DNA, 58 bp, Artificial Sequence
  Description of Artificial Sequence: Synthetic oligonucleotide
aattcaaaaatggcctgtgtctagttgtttgctcgagcaaacaactagacacaggcca

SEQ ID NO: 2315 - DNA, 58 bp, Artificial Sequence
  Description of Artificial Sequence: Synthetic oligonucleotide
aattcaaaaatgggatccctcatcctcatacctcgaggtatgaggatgagggatccca

SEQ ID NO: 2316 - DNA, 58 bp, Artificial Sequence
  Description of Artificial Sequence: Synthetic oligonucleotide
aattcaaaaagctttgctcatccactatcaactcgagttgatagtggatgagcaaagc

SEQ ID NO: 2317 - DNA, 58 bp, Artificial Sequence
  Description of Artificial Sequence: Synthetic oligonucleotide
aattcaaaaaacctgcacactgtcctattatctcgagataataggacagtgtgcaggt

SEQ ID NO: 2318 - DNA, 58 bp, Artificial Sequence
  Description of Artificial Sequence: Synthetic oligonucleotide
aattcaaaaaagatgctgaacagtgacaaatctcgagatttgtcactgttcagcatct

SEQ ID NO: 2319 - DNA, 58 bp, Artificial Sequence
  Description of Artificial Sequence: Synthetic oligonucleotide
aattcaaaaagttctccagtcattatgttaactcgagttaacataatgactggagaac

SEQ ID NO: 2320 - DNA, 58 bp, Artificial Sequence
  Description of Artificial Sequence: Synthetic oligonucleotide
aattcaaaaagtatatgtcaagccataattgctcgagcaattatggcttgacatatac

SEQ ID NO: 2321 - DNA, 58 bp, Artificial Sequence
  Description of Artificial Sequence: Synthetic oligonucleotide
aattcaaaaaactctaccctggcactataatctcgagattatagtgccagggtagagt

SEQ ID NO: 2322 - DNA, 58 bp, Artificial Sequence
  Description of Artificial Sequence: Synthetic oligonucleotide
aattcaaaaacctgttaatccaaggtctttactcgagtaaagaccttggattaacagg

SEQ ID NO: 2323 - DNA, 58 bp, Artificial Sequence
  Description of Artificial Sequence: Synthetic oligonucleotide
aattcaaaaagctggttaccatcggagtttactcgagtaaactccgatggtaaccagc

SEQ ID NO: 2324 - DNA, 58 bp, Artificial Sequence
  Description of Artificial Sequence: Synthetic oligonucleotide
aattcaaaaagcagtgaaagtggcagatattctcgagaatatctgccactttcactgc

SEQ ID NO: 2325 - DNA, 58 bp, Artificial Sequence
  Description of Artificial Sequence: Synthetic oligonucleotide
aattcaaaaagaagcaagcaaggcttataatctcgagattataagccttgcttgcttc

SEQ ID NO: 2326 - DNA, 58 bp, Artificial Sequence
  Description of Artificial Sequence: Synthetic oligonucleotide
aattcaaaaagcttagactaaggccattattctcgagaataatggccttagtctaagc

SEQ ID NO: 2327 - DNA, 58 bp, Artificial Sequence
  Description of Artificial Sequence: Synthetic oligonucleotide
aattcaaaaactctcactataccagtataatctcgagattatactggtatagtgagag

SEQ ID NO: 2328 - DNA, 58 bp, Artificial Sequence
  Description of Artificial Sequence: Synthetic oligonucleotide
aattcaaaaacaaactgtgcccttcagattgctcgagcaatctgaagggcacagtttg

SEQ ID NO: 2329 - DNA, 58 bp, Artificial Sequence
  Description of Artificial Sequence: Synthetic oligonucleotide
aattcaaaaagattccctgatgctgatatttctcgagaaatatcagcatcagggaatc

SEQ ID NO: 2330 - DNA, 58 bp, Artificial Sequence
  Description of Artificial Sequence: Synthetic oligonucleotide
aattcaaaaaaggaatccatgtagtagatatctcgagatatctactacatggattcct

SEQ ID NO: 2331 - DNA, 58 bp, Artificial Sequence
  Description of Artificial Sequence: Synthetic oligonucleotide
aattcaaaaaaggtgttctggaggtctattactcgagtaatagacctccagaacacct

SEQ ID NO: 2332 - DNA, 58 bp, Artificial Sequence
  Description of Artificial Sequence: Synthetic oligonucleotide
aattcaaaaaatttgtccatacgtcactatactcgagtatagtgacgtatggacaaat

SEQ ID NO: 2333 - DNA, 58 bp, Artificial Sequence
  Description of Artificial Sequence: Synthetic oligonucleotide
aattcaaaaacaaaggactttgcagattaaactcgagtttaatctgcaaagtcctttg

SEQ ID NO: 2334 - DNA, 58 bp, Artificial Sequence
  Description of Artificial Sequence: Synthetic oligonucleotide
aattcaaaaagcgcagggtctacgaagaatactcgagtattcttcgtagaccctgcgc

SEQ ID NO: 2335 - DNA, 58 bp, Artificial Sequence
  Description of Artificial Sequence: Synthetic oligonucleotide
aattcaaaaaacatccagcctacacgtatttctcgagaaatacgtgtaggctggatgt

SEQ ID NO: 2336 - DNA, 58 bp, Artificial Sequence
  Description of Artificial Sequence: Synthetic oligonucleotide
aattcaaaaatctgaaggtgcgaggattatactcgagtataatcctcgcaccttcaga

SEQ ID NO: 2337 - DNA, 58 bp, Artificial Sequence
  Description of Artificial Sequence: Synthetic oligonucleotide
aattcaaaaatccagatctgccggttcattactcgagtaatgaaccggcagatctgga

SEQ ID NO: 2338 - DNA, 58 bp, Artificial Sequence
  Description of Artificial Sequence: Synthetic oligonucleotide
aattcaaaaagcgcccactcttccaattaaactcgagtttaattggaagagtgggcgc

SEQ ID NO: 2339 - DNA, 58 bp, Artificial Sequence
  Description of Artificial Sequence: Synthetic oligonucleotide
aattcaaaaatccagagcctgccagcaatttctcgagaaattgctggcaggctctgga

SEQ ID NO: 2340 - DNA, 58 bp, Artificial Sequence
  Description of Artificial Sequence: Synthetic oligonucleotide
aattcaaaaaagaatgtgagtgcaaagattgctcgagcaatctttgcactcacattct

SEQ ID NO: 2341 - DNA, 58 bp, Artificial Sequence
  Description of Artificial Sequence: Synthetic oligonucleotide
aattcaaaaacttgcacactctcccattatactcgagtataatgggagagtgtgcaag

SEQ ID NO: 2342 - DNA, 58 bp, Artificial Sequence
  Description of Artificial Sequence: Synthetic oligonucleotide
aattcaaaaagcagatattctctagtcatttctcgagaaatgactagagaatatctgc

SEQ ID NO: 2343 - DNA, 58 bp, Artificial Sequence
  Description of Artificial Sequence: Synthetic oligonucleotide
aattcaaaaaatttcttcgtgatgacatatcctcgaggatatgtcatcacgaagaaat

SEQ ID NO: 2344 - DNA, 58 bp, Artificial Sequence
  Description of Artificial Sequence: Synthetic oligonucleotide
aattcaaaaattacgagggttctacttatttctcgagaaataagtagaaccctcgtaa

SEQ ID NO: 2345 - DNA, 58 bp, Artificial Sequence
  Description of Artificial Sequence: Synthetic oligonucleotide
aattcaaaaaatttagtgggagaccataatgctcgagcattatggtctcccactaaat

SEQ ID NO: 2346 - DNA, 58 bp, Artificial Sequence
  Description of Artificial Sequence: Synthetic oligonucleotide
aattcaaaaaactgacaggagagaagtaagactcgagtcttacttctctcctgtcagt

SEQ ID NO: 2347 - DNA, 58 bp, Artificial Sequence
  Description of Artificial Sequence: Synthetic oligonucleotide
aattcaaaaatgaattgtaggtgactattatctcgagataatagtcacctacaattca

SEQ ID NO: 2348 - DNA, 58 bp, Artificial Sequence
  Description of Artificial Sequence: Synthetic oligonucleotide
aattcaaaaacagaccacgcaaggagttcatctcgagatgaactccttgcgtggtctg

SEQ ID NO: 2349 - DNA, 58 bp, Artificial Sequence
  Description of Artificial Sequence: Synthetic oligonucleotide
aattcaaaaacgggaaggaaatttgtcttgactcgagtcaagacaaatttccttcccg

SEQ ID NO: 2350 - DNA, 58 bp, Artificial Sequence
  Description of Artificial Sequence: Synthetic oligonucleotide
aattcaaaaatttaccctaggatgctatttactcgagtaaatagcatcctagggtaaa

SEQ ID NO: 2351 - DNA, 58 bp, Artificial Sequence
  Description of Artificial Sequence: Synthetic oligonucleotide
aattcaaaaagttgcacttgtttacgcgttactcgagtaacgcgtaaacaagtgcaac

SEQ ID NO: 2352 - DNA, 58 bp, Artificial Sequence
  Description of Artificial Sequence: Synthetic oligonucleotide
aattcaaaaagctgtggatttcgtatggaaactcgagtttccatacgaaatccacagc

SEQ ID NO: 2353 - DNA, 58 bp, Artificial Sequence
  Description of Artificial Sequence: Synthetic oligonucleotide
aattcaaaaatgcgccaacacagaaattattctcgagaataatttctgtgttggcgca

SEQ ID NO: 2354 - DNA, 58 bp, Artificial Sequence
  Description of Artificial Sequence: Synthetic oligonucleotide
aattcaaaaacaagagaatatccgaactttactcgagtaaagttcggatattctcttg

SEQ ID NO: 2355 - DNA, 58 bp, Artificial Sequence
  Description of Artificial Sequence: Synthetic oligonucleotide
aattcaaaaatgcacgggagaatatacaaatctcgagatttgtatattctcccgtgca

SEQ ID NO: 2356 - DNA, 58 bp, Artificial Sequence
  Description of Artificial Sequence: Synthetic oligonucleotide
aattcaaaaaccaaaggaggatggcatataactcgagttatatgccatcctcctttgg

SEQ ID NO: 2357 - DNA, 58 bp, Artificial Sequence
  Description of Artificial Sequence: Synthetic oligonucleotide
aattcaaaaaccaaacgttaagaattgttaactcgagttaacaattcttaacgtttgg

SEQ ID NO: 2358 - DNA, 58 bp, Artificial Sequence
  Description of Artificial Sequence: Synthetic oligonucleotide
aattcaaaaagatgtgaaggaactgattaaactcgagtttaatcagttccttcacatc

SEQ ID NO: 2359 - DNA, 58 bp, Artificial Sequence
  Description of Artificial Sequence: Synthetic oligonucleotide
aattcaaaaacttggcacgtcatcgtgttacctcgaggtaacacgatgacgtgccaag

SEQ ID NO: 2360 - DNA, 58 bp, Artificial Sequence
  Description of Artificial Sequence: Synthetic oligonucleotide
aattcaaaaaacccactaactggctaattagctcgagctaattagccagttagtgggt

SEQ ID NO: 2361 - DNA, 58 bp, Artificial Sequence
  Description of Artificial Sequence: Synthetic oligonucleotide
aattcaaaaagagacactcaacaagtatgttctcgagaacatacttgttgagtgtctc

SEQ ID NO: 2362 - DNA, 58 bp, Artificial Sequence
  Description of Artificial Sequence: Synthetic oligonucleotide
aattcaaaaagaagcgctacttggtcaaattctcgagaatttgaccaagtagcgcttc

SEQ ID NO: 2363 - DNA, 58 bp, Artificial Sequence
  Description of Artificial Sequence: Synthetic oligonucleotide
aattcaaaaagccactaaattgacacttaaactcgagtttaagtgtcaatttagtggc

SEQ ID NO: 2364 - DNA, 58 bp, Artificial Sequence
  Description of Artificial Sequence: Synthetic oligonucleotide
aattcaaaaaccctggaaatcaacaagtattctcgagaatacttgttgatttccaggg

SEQ ID NO: 2365 - DNA, 58 bp, Artificial Sequence
  Description of Artificial Sequence: Synthetic oligonucleotide
aattcaaaaaccttctcatttggaaactaaactcgagtttagtttccaaatgagaagg

SEQ ID NO: 2366 - DNA, 58 bp, Artificial Sequence
  Description of Artificial Sequence: Synthetic oligonucleotide
aattcaaaaacgctacctgaacatagttcatctcgagatgaactatgttcaggtagcg

SEQ ID NO: 2367 - DNA, 58 bp, Artificial Sequence
  Description of Artificial Sequence: Synthetic oligonucleotide
aattcaaaaagagtacaaggcatggcgtagactcgagtctacgccatgccttgtactc

SEQ ID NO: 2368 - DNA, 58 bp, Artificial Sequence
  Description of Artificial Sequence: Synthetic oligonucleotide
aattcaaaaactattcccgacttcatctttgctcgagcaaagatgaagtcgggaatag

SEQ ID NO: 2369 - DNA, 58 bp, Artificial Sequence
  Description of Artificial Sequence: Synthetic oligonucleotide
aattcaaaaagcgtgtagtgaatcacgtaaactcgagtttacgtgattcactacacgc

SEQ ID NO: 2370 - DNA, 58 bp, Artificial Sequence
  Description of Artificial Sequence: Synthetic oligonucleotide
aattcaaaaacctgttcttaagacgtgatttctcgagaaatcacgtcttaagaacagg

SEQ ID NO: 2371 - DNA, 58 bp, Artificial Sequence
  Description of Artificial Sequence: Synthetic oligonucleotide
aattcaaaaagcttgctcatctgggtgatatctcgagatatcacccagatgagcaagc

SEQ ID NO: 2372 - DNA, 58 bp, Artificial Sequence
  Description of Artificial Sequence: Synthetic oligonucleotide
aattcaaaaatactgggcatctacactattactcgagtaatagtgtagatgcccagta

SEQ ID NO: 2373 - DNA, 58 bp, Artificial Sequence
  Description of Artificial Sequence: Synthetic oligonucleotide
aattcaaaaattatctatggcaatgtctttactcgagtaaagacattgccatagataa

SEQ ID NO: 2374 - DNA, 58 bp, Artificial Sequence
  Description of Artificial Sequence: Synthetic oligonucleotide
aattcaaaaatgaactgtcactgtgagatatctcgagatatctcacagtgacagttca

SEQ ID NO: 2375 - DNA, 58 bp, Artificial Sequence
  Description of Artificial Sequence: Synthetic oligonucleotide
aattcaaaaaatgtactactctctcctttacctcgaggtaaaggagagagtagtacat

SEQ ID NO: 2376 - DNA, 58 bp, Artificial Sequence
  Description of Artificial Sequence: Synthetic oligonucleotide
aattcaaaaagcctttcataacagagcacatctcgagatgtgctctgttatgaaaggc

SEQ ID NO: 2377 - DNA, 58 bp, Artificial Sequence
  Description of Artificial Sequence: Synthetic oligonucleotide
aattcaaaaaccatgagaaacagcgtcaaatctcgagatttgacgctgtttctcatgg

SEQ ID NO: 2378 - DNA, 58 bp, Artificial Sequence
  Description of Artificial Sequence: Synthetic oligonucleotide
aattcaaaaagctcgtccctgatggataaagctcgagctttatccatcagggacgagc

SEQ ID NO: 2379 - DNA, 58 bp, Artificial Sequence
  Description of Artificial Sequence: Synthetic oligonucleotide
aattcaaaaaagacaagaagtgctggaatttctcgagaaattccagcacttcttgtct

SEQ ID NO: 2380 - DNA, 58 bp, Artificial Sequence
  Description of Artificial Sequence: Synthetic oligonucleotide
aattcaaaaagcactgcgtggcgaatgtaaactcgagtttacattcgccacgcagtgc

SEQ ID NO: 2381 - DNA, 58 bp, Artificial Sequence
  Description of Artificial Sequence: Synthetic oligonucleotide
aattcaaaaatgctcaacgacatcgtgattcctcgaggaatcacgatgtcgttgagca

SEQ ID NO: 2382 - DNA, 58 bp, Artificial Sequence
  Description of Artificial Sequence: Synthetic oligonucleotide
aattcaaaaacaacgggctaatccacggaatctcgagattccgtggattagcccgttg

SEQ ID NO: 2383 - DNA, 58 bp, Artificial Sequence
  Description of Artificial Sequence: Synthetic oligonucleotide
aattcaaaaagcaggtgtcagcaagtatgatctcgagatcatacttgctgacacctgc

SEQ ID NO: 2384 - DNA, 58 bp, Artificial Sequence; identical to SEQ ID NO: 2383
  Description of Artificial Sequence: Synthetic oligonucleotide

SEQ ID NO: 2385 - DNA, 58 bp, Artificial Sequence
  Description of Artificial Sequence: Synthetic oligonucleotide
aattcaaaaagtcttgcagaaacagtccattctcgagaatggactgtttctgcaagac

SEQ ID NO: 2386 - DNA, 58 bp, Artificial Sequence
  Description of Artificial Sequence: Synthetic oligonucleotide
aattcaaaaacccagacaccaaagttaatttctcgagaaattaactttggtgtctggg

SEQ ID NO: 2387 - DNA, 58 bp, Artificial Sequence
  Description of Artificial Sequence: Synthetic oligonucleotide
aattcaaaaatgcagctgcatgtggataaagctcgagctttatccacatgcagctgca

SEQ ID NO: 2388 - DNA, 58 bp, Artificial Sequence
  Description of Artificial Sequence: Synthetic oligonucleotide
aattcaaaaaagagcaactctgagatctaagctcgagcttagatctcagagttgctct

SEQ ID NO: 2389 - DNA, 58 bp, Artificial Sequence
  Description of Artificial Sequence: Synthetic oligonucleotide
aattcaaaaattggaactcccttccgaaattctcgagaatttcggaagggagttccaa

SEQ ID NO: 2390 - DNA, 58 bp, Artificial Sequence
  Description of Artificial Sequence: Synthetic oligonucleotide
aattcaaaaataaatccaacagcccatatttctcgagaaatatgggctgttggattta

SEQ ID NO: 2391 - DNA, 58 bp, Artificial Sequence
  Description of Artificial Sequence: Synthetic oligonucleotide
aattcaaaaatcaggtctagctgggtatttactcgagtaaatacccagctagacctga

SEQ ID NO: 2392 - DNA, 58 bp, Artificial Sequence
  Description of Artificial Sequence: Synthetic oligonucleotide
aattcaaaaacttggtgtgtgcatgagtattctcgagaatactcatgcacacaccaag

SEQ ID NO: 2393 - DNA, 58 bp, Artificial Sequence
  Description of Artificial Sequence: Synthetic oligonucleotide
aattcaaaaagaggagatgtggcaccatttactcgagtaaatggtgccacatctcctc

SEQ ID NO: 2394 - DNA, 58 bp, Artificial Sequence
  Description of Artificial Sequence: Synthetic oligonucleotide
aattcaaaaagccatacaagatggaacaatactcgagtattgttccatcttgtatggc

SEQ ID NO: 2395 - DNA, 58 bp, Artificial Sequence
  Description of Artificial Sequence: Synthetic oligonucleotide
aattcaaaaacacctagtgaaattccttaaactcgagtttaaggaatttcactaggtg

SEQ ID NO: 2396 - DNA, 58 bp, Artificial Sequence
  Description of Artificial Sequence: Synthetic oligonucleotide
aattcaaaaacatgtactctggagatgttatctcgagataacatctccagagtacatg

SEQ ID NO: 2397 - DNA, 58 bp, Artificial Sequence
  Description of Artificial Sequence: Synthetic oligonucleotide
aattcaaaaacaatgtgggcagaggcctaaactcgagtttaggcctctgcccacattg

SEQ ID NO: 2398 - DNA, 58 bp, Artificial Sequence
  Description of Artificial Sequence: Synthetic oligonucleotide
aattcaaaaagcgtatgacacattgattaaactcgagtttaatcaatgtgtcatacgc

SEQ ID NO: 2399 - DNA, 58 bp, Artificial Sequence
  Description of Artificial Sequence: Synthetic oligonucleotide
aattcaaaaacctgaaacagtggcaataaatctcgagatttattgccactgtttcagg

SEQ ID NO: 2400 - DNA, 58 bp, Artificial Sequence
  Description of Artificial Sequence: Synthetic oligonucleotide
aattcaaaaactatcatcctcaaggacattactcgagtaatgtccttgaggatgatag

SEQ ID NO: 2401 - DNA, 58 bp, Artificial Sequence
  Description of Artificial Sequence: Synthetic oligonucleotide
aattcaaaaagactagaggcttgcataataactcgagttattatgcaagcctctagtc

SEQ ID NO: 2402 - DNA, 58 bp, Artificial Sequence
  Description of Artificial Sequence: Synthetic oligonucleotide
aattcaaaaaactgggctgtactttgtatatctcgagatatacaaagtacagcccagt

SEQ ID NO: 2403 - DNA, 58 bp, Artificial Sequence
  Description of Artificial Sequence: Synthetic oligonucleotide
aattcaaaaatgagctctctctggtcaatttctcgagaaattgaccagagagagctca

SEQ ID NO: 2404 - DNA, 58 bp, Artificial Sequence
  Description of Artificial Sequence: Synthetic oligonucleotide
aattcaaaaagaaacgaactgggcagtataactcgagttatactgcccagttcgtttc

SEQ ID NO: 2405 - DNA, 58 bp, Artificial Sequence
  Description of Artificial Sequence: Synthetic oligonucleotide
aattcaaaaatatagctcagtttggataattctcgagaattatccaaactgagctata

SEQ ID NO: 2406 - DNA, 58 bp, Artificial Sequence
  Description of Artificial Sequence: Synthetic oligonucleotide
aattcaaaaatgaacgattggaatctaataactcgagttattagattccaatcgttca

SEQ ID NO: 2407 - DNA, 58 bp, Artificial Sequence
  Description of Artificial Sequence: Synthetic oligonucleotide
aattcaaaaactgtctgactacctgcttcaactcgagttgaagcaggtagtcagacag

SEQ ID NO: 2408 - DNA, 58 bp, Artificial Sequence
  Description of Artificial Sequence: Synthetic oligonucleotide
aattcaaaaatcctccgacttcgctgtcaaactcgagtttgacagcgaagtcggagga

SEQ ID NO: 2409 - DNA, 58 bp, Artificial Sequence
  Description of Artificial Sequence: Synthetic oligonucleotide
aattcaaaaagcttcgtccagaccaacatctctcgagagatgttggtctggacgaagc

SEQ ID NO: 2410 - DNA, 58 bp, Artificial Sequence
  Description of Artificial Sequence: Synthetic oligonucleotide
aattcaaaaaagctggagttccgcaagaaacctcgaggtttcttgcggaactccagct

SEQ ID NO: 2411 - DNA, 58 bp, Artificial Sequence
  Description of Artificial Sequence: Synthetic oligonucleotide
aattcaaaaatcctacccactgctggcaaatctcgagatttgccagcagtgggtagga

SEQ ID NO: 2412 - DNA, 58 bp, Artificial Sequence
  Description of Artificial Sequence: Synthetic oligonucleotide
aattcaaaaatgtccctcactcaacacaaacctcgaggtttgtgttgagtgagggaca

SEQ ID NO: 2413 - DNA, 58 bp, Artificial Sequence
  Description of Artificial Sequence: Synthetic oligonucleotide
aattcaaaaacacacgcatgtttgccttcttctcgagaagaaggcaaacatgcgtgtg

SEQ ID NO: 2414 - DNA, 58 bp, Artificial Sequence
  Description of Artificial Sequence: Synthetic oligonucleotide
aattcaaaaacgtgtgtgattgcctgttattctcgagaataacaggcaatcacacacg

SEQ ID NO: 2415 - DNA, 58 bp, Artificial Sequence
  Description of Artificial Sequence: Synthetic oligonucleotide
aattcaaaaatctcagtatgtgctataatatctcgagatattatagcacatactgaga

SEQ ID NO: 2416 - DNA, 58 bp, Artificial Sequence
  Description of Artificial Sequence: Synthetic oligonucleotide
aattcaaaaattctcagtatgtgctataatactcgagtattatagcacatactgagaa

SEQ ID NO: 2417 - DNA, 58 bp, Artificial Sequence
  Description of Artificial Sequence: Synthetic oligonucleotide
aattcaaaaaagcctaaacgcgatggatatactcgagtatatccatcgcgtttaggct

SEQ ID NO: 2418 - DNA, 58 bp, Artificial Sequence
  Description of Artificial Sequence: Synthetic oligonucleotide
aattcaaaaacccaagaacagctcgtttaacctcgaggttaaacgagctgttcttggg

SEQ ID NO: 2419 - DNA, 58 bp, Artificial Sequence
  Description of Artificial Sequence: Synthetic oligonucleotide
aattcaaaaagccaagaagtttaaggaatatctcgagatattccttaaacttcttggc

SEQ ID NO: 2420 - DNA, 58 bp, Artificial Sequence
  Description of Artificial Sequence: Synthetic oligonucleotide
aattcaaaaaccctgtaattgttgtttgtatctcgagatacaaacaacaattacaggg

SEQ ID NO: 2421 - DNA, 58 bp, Artificial Sequence
  Description of Artificial Sequence: Synthetic oligonucleotide
aattcaaaaaccagatgagtacctgacatacctcgaggtatgtcaggtactcatctgg

SEQ ID NO: 2422 - DNA, 58 bp, Artificial Sequence
  Description of Artificial Sequence: Synthetic oligonucleotide
aattcaaaaacgacgaaaggcatgtaccatactcgagtatggtacatgcctttcgtcg

SEQ ID NO: 2423 - DNA, 58 bp, Artificial Sequence; identical to SEQ ID NO: 2422
  Description of Artificial Sequence: Synthetic oligonucleotide

SEQ ID NO: 2424 - DNA, 58 bp, Artificial Sequence
  Description of Artificial Sequence: Synthetic oligonucleotide
aattcaaaaagttcaccaagctcaacatttactcgagtaaatgttgagcttggtgaac

SEQ ID NO: 2425 - DNA, 58 bp, Artificial Sequence
  Description of Artificial Sequence: Synthetic oligonucleotide
aattcaaaaagagttcaccaagctcaacattctcgagaatgttgagcttggtgaactc

SEQ ID NO: 2426 - DNA, 58 bp, Artificial Sequence
  Description of Artificial Sequence: Synthetic oligonucleotide
aattcaaaaacccttatgaacctctactggtctcgagaccagtagaggttcataaggg

SEQ ID NO: 2427 - DNA, 58 bp, Artificial Sequence
  Description of Artificial Sequence: Synthetic oligonucleotide
aattcaaaaacaggataatcgtggtgtaaatctcgagatttacaccacgattatcctg

SEQ ID NO: 2428 - DNA, 58 bp, Artificial Sequence
  Description of Artificial Sequence: Synthetic oligonucleotide
aattcaaaaacgaccagaaggccgtgtatttctcgagaaatacacggccttctggtcg

SEQ ID NO: 2429 - DNA, 58 bp, Artificial Sequence
  Description of Artificial Sequence: Synthetic oligonucleotide
aattcaaaaactgtccgccagtgcatcattactcgagtaatgatgcactggcggacag

SEQ ID NO: 2430 - DNA, 58 bp, Artificial Sequence
  Description of Artificial Sequence: Synthetic oligonucleotide
aattcaaaaacctgcagatcttgcgactaaactcgagtttagtcgcaagatctgcagg

SEQ ID NO: 2431 - DNA, 58 bp, Artificial Sequence
  Description of Artificial Sequence: Synthetic oligonucleotide
aattcaaaaagatcgctgtggctgctcttaactcgagttaagagcagccacagcgatc

SEQ ID NO: 2432 - DNA, 58 bp, Artificial Sequence
  Description of Artificial Sequence: Synthetic oligonucleotide
aattcaaaaagagatgtagagacagtgatagctcgagctatcactgtctctacatctc

SEQ ID NO: 2433 - DNA, 58 bp, Artificial Sequence
  Description of Artificial Sequence: Synthetic oligonucleotide
aattcaaaaaagactccagattccgagagttctcgagaactctcggaatctggagtct

SEQ ID NO: 2434 - DNA, 58 bp, Artificial Sequence
  Description of Artificial Sequence: Synthetic oligonucleotide
aattcaaaaagctccagacctatgatgacttctcgagaagtcatcataggtctggagc

SEQ ID NO: 2435 - DNA, 58 bp, Artificial Sequence
  Description of Artificial Sequence: Synthetic oligonucleotide
aattcaaaaaagagctgggaagattcgaacactcgagtgttcgaatcttcccagctct

SEQ ID NO: 2436 - DNA, 58 bp, Artificial Sequence
  Description of Artificial Sequence: Synthetic oligonucleotide
aattcaaaaacaacaggtacacgtccgataactcgagttatcggacgtgtacctgttg

SEQ ID NO: 2437 - DNA, 58 bp, Artificial Sequence
  Description of Artificial Sequence: Synthetic oligonucleotide
aattcaaaaatgaaaggaagcgtggtcatttctcgagaaatgaccacgcttcctttca

SEQ ID NO: 2438 - DNA, 58 bp, Artificial Sequence
  Description of Artificial Sequence: Synthetic oligonucleotide
aattcaaaaatatgaagcctacgagtgtaagctcgagcttacactcgtaggcttcata

SEQ ID NO: 2439 - DNA, 58 bp, Artificial Sequence
  Description of Artificial Sequence: Synthetic oligonucleotide
aattcaaaaaaccgtcaccagctattcattactcgagtaatgaatagctggtgacggt

SEQ ID NO: 2440 - DNA, 58 bp, Artificial Sequence
  Description of Artificial Sequence: Synthetic oligonucleotide
aattcaaaaactctcaacagctccaattatgctcgagcataattggagctgttgagag

SEQ ID NO: 2441 - DNA, 58 bp, Artificial Sequence
  Description of Artificial Sequence: Synthetic oligonucleotide
aattcaaaaattgggccaggcagtccaatttctcgagaaattggactgcctggcccaa

SEQ ID NO: 2442 - DNA, 58 bp, Artificial Sequence
  Description of Artificial Sequence: Synthetic oligonucleotide
aattcaaaaacaacaccatcaccagctttatctcgagataaagctggtgatggtgttg

SEQ ID NO: 2443 - DNA, 58 bp, Artificial Sequence
  Description of Artificial Sequence: Synthetic oligonucleotide
aattcaaaaaatgagactcagcccaccatttctcgagaaatggtgggctgagtctcat

SEQ ID NO: 2444 - DNA, 58 bp, Artificial Sequence
  Description of Artificial Sequence: Synthetic oligonucleotide
aattcaaaaatgagtgtgacttgggctaaagctcgagctttagcccaagtcacactca

SEQ ID NO: 2445 - DNA, 58 bp, Artificial Sequence
  Description of Artificial Sequence: Synthetic oligonucleotide
aattcaaaaagactcccatcagcattctatactcgagtatagaatgctgatgggagtc

SEQ ID NO: 2446 - DNA, 58 bp, Artificial Sequence
  Description of Artificial Sequence: Synthetic oligonucleotide
aattcaaaaacgagtacatgctgtcaatctactcgagtagattgacagcatgtactcg

SEQ ID NO: 2447 - DNA, 58 bp, Artificial Sequence
  Description of Artificial Sequence: Synthetic oligonucleotide
aattcaaaaacagtcttccaagtcggctaatctcgagattagccgacttggaagactg

SEQ ID NO: 2448 - DNA, 58 bp, Artificial Sequence
  Description of Artificial Sequence: Synthetic oligonucleotide
aattcaaaaagcagaggaaagagagcttattctcgagaataagctctctttcctctgc

SEQ ID NO: 2449 - DNA, 58 bp, Artificial Sequence
  Description of Artificial Sequence: Synthetic oligonucleotide
aattcaaaaagttcgacgtgtccagccttaactcgagttaaggctggacacgtcgaac

SEQ ID NO: 2450 - DNA, 58 bp, Artificial Sequence
  Description of Artificial Sequence: Synthetic oligonucleotide
aattcaaaaaccacttcatgatgtcgctttactcgagtaaagcgacatcatgaagtgg

SEQ ID NO: 2451 - DNA, 58 bp, Artificial Sequence
  Description of Artificial Sequence: Synthetic oligonucleotide
aattcaaaaagatggctcaattgcctataaactcgagtttataggcaattgagccatc

SEQ ID NO: 2452 - DNA, 58 bp, Artificial Sequence
  Description of Artificial Sequence: Synthetic oligonucleotide
aattcaaaaaccatcagtggaactgctatttctcgagaaatagcagttccactgatgg

SEQ ID NO: 2453 - DNA, 58 bp, Artificial Sequence
  Description of Artificial Sequence: Synthetic oligonucleotide
aattcaaaaagagtgaatacttcagacaattctcgagaattgtctgaagtattcactc

SEQ ID NO: 2454 - DNA, 58 bp, Artificial Sequence
  Description of Artificial Sequence: Synthetic oligonucleotide
aattcaaaaacgtctggtatgtctccaacatctcgagatgttggagacataccagacg

SEQ ID NO: 2455 - DNA, 58 bp, Artificial Sequence; identical to SEQ ID NO: 2454
  Description of Artificial Sequence: Synthetic oligonucleotide

SEQ ID NO: 2456 - DNA, 58 bp, Artificial Sequence
  Description of Artificial Sequence: Synthetic oligonucleotide
aattcaaaaagcggatgttcaatggtgagaactcgagttctcaccattgaacatccgc

SEQ ID NO: 2457 - DNA, 58 bp, Artificial Sequence
  Description of Artificial Sequence: Synthetic oligonucleotide
aattcaaaaagcagtgtcgttgcatatccatctcgagatggatatgcaacgacactgc

SEQ ID NO: 2458 - DNA, 58 bp, Artificial Sequence
  Description of Artificial Sequence: Synthetic oligonucleotide
aattcaaaaaacagccacctaccaagaagaactcgagttcttcttggtaggtggctgt

SEQ ID NO: 2459 - DNA, 58 bp, Artificial Sequence
  Description of Artificial Sequence: Synthetic oligonucleotide
aattcaaaaacaacagtcgcaccatcatcaactcgagttgatgatggtgcgactgttg

SEQ ID NO: 2460 - DNA, 58 bp, Artificial Sequence
  Description of Artificial Sequence: Synthetic oligonucleotide
aattcaaaaagctgtgaaggaaggaaatttactcgagtaaatttccttccttcacagc

SEQ ID NO: 2461 - DNA, 58 bp, Artificial Sequence
  Description of Artificial Sequence: Synthetic oligonucleotide
aattcaaaaacaaggtgcatttctgtcatttctcgagaaatgacagaaatgcaccttg

SEQ ID NO: 2462 - DNA, 58 bp, Artificial Sequence
  Description of Artificial Sequence: Synthetic oligonucleotide
aattcaaaaacggaagtagacgtaacttattctcgagaataagttacgtctacttccg

SEQ ID NO: 2463 - DNA, 58 bp, Artificial Sequence
  Description of Artificial Sequence: Synthetic oligonucleotide
aattcaaaaagccctgatagtcagttcgaatctcgagattcgaactgactatcagggc

SEQ ID NO: 2464 - DNA, 58 bp, Artificial Sequence; identical to SEQ ID NO: 2463
  Description of Artificial Sequence: Synthetic oligonucleotide

SEQ ID NO: 2465 - DNA, 58 bp, Artificial Sequence
  Description of Artificial Sequence: Synthetic oligonucleotide
aattcaaaaacttccaaagatcaggtaacaactcgagttgttacctgatctttggaag

SEQ ID NO: 2466 - DNA, 58 bp, Artificial Sequence
  Description of Artificial Sequence: Synthetic oligonucleotide
aattcaaaaaacagacacttcgggactcaatctcgagattgagtcccgaagtgtctgt

SEQ ID NO: 2467 - DNA, 58 bp, Artificial Sequence
  Description of Artificial Sequence: Synthetic oligonucleotide
aattcaaaaaccagcccaaatcctatttcaactcgagttgaaataggatttgggctgg

SEQ ID NO: 2468 - DNA, 58 bp, Artificial Sequence
  Description of Artificial Sequence: Synthetic oligonucleotide
aattcaaaaaccagaggccatttcataggttctcgagaacctatgaaatggcctctgg

SEQ ID NO: 2469 - DNA, 58 bp, Artificial Sequence
  Description of Artificial Sequence: Synthetic oligonucleotide
aattcaaaaagacatgatcattagccataagctcgagcttatggctaatgatcatgtc

SEQ ID NO: 2470 - DNA, 58 bp, Artificial Sequence
  Description of Artificial Sequence: Synthetic oligonucleotide
aattcaaaaagcctacattggcacaactatactcgagtatagttgtgccaatgtaggc

SEQ ID NO: 2471 - DNA, 58 bp, Artificial Sequence
  Description of Artificial Sequence: Synthetic oligonucleotide
aattcaaaaagaagctcaccatcatatttaactcgagttaaatatgatggtgagcttc

SEQ ID NO: 2472 - DNA, 58 bp, Artificial Sequence
  Description of Artificial Sequence: Synthetic oligonucleotide
aattcaaaaagatgcagcttatacgaaataactcgagttatttcgtataagctgcatc

SEQ ID NO: 2473 - DNA, 58 bp, Artificial Sequence
  Description of Artificial Sequence: Synthetic oligonucleotide
aattcaaaaagttggtgcacagcacaaattactcgagtaatttgtgctgtgcaccaac

SEQ ID NO: 2474 - DNA, 58 bp, Artificial Sequence
  Description of Artificial Sequence: Synthetic oligonucleotide
aattcaaaaaagaagatgatgatgatgaatactcgagtattcatcatcatcatcttct

SEQ ID NO: 2475 - DNA, 58 bp, Artificial Sequence
  Description of Artificial Sequence: Synthetic oligonucleotide
aattcaaaaacctgccagtacctcaaagattctcgagaatctttgaggtactggcagg

SEQ ID NO: 2476 - DNA, 58 bp, Artificial Sequence; identical to SEQ ID NO: 2475
  Description of Artificial Sequence: Synthetic oligonucleotide

SEQ ID NO: 2477 - DNA, 58 bp, Artificial Sequence
  Description of Artificial Sequence: Synthetic oligonucleotide
aattcaaaaactggacctgaatgcctttgatctcgagatcaaaggcattcaggtccag

SEQ ID NO: 2478 - DNA, 58 bp, Artificial Sequence
  Description of Artificial Sequence: Synthetic oligonucleotide
aattcaaaaagtccagctcacgaggcaaatactcgagtatttgcctcgtgagctggac

SEQ ID NO: 2479 - DNA, 58 bp, Artificial Sequence
  Description of Artificial Sequence: Synthetic oligonucleotide
aattcaaaaaccagctcaacttcagctaaatctcgagatttagctgaagttgagctgg

SEQ ID NO: 2480 - DNA, 58 bp, Artificial Sequence
  Description of Artificial Sequence: Synthetic oligonucleotide
aattcaaaaagcacttgaaatggaaagataactcgagttatctttccatttcaagtgc

SEQ ID NO: 2481 - DNA, 58 bp, Artificial Sequence
  Description of Artificial Sequence: Synthetic oligonucleotide
aattcaaaaagagcggcagttaccatgttagctcgagctaacatggtaactgccgctc

SEQ ID NO: 2482 - DNA, 58 bp, Artificial Sequence
  Description of Artificial Sequence: Synthetic oligonucleotide
aattcaaaaagcacgaccctaacggtgaatactcgagtattcaccgttagggtcgtgc

SEQ ID NO: 2483 - DNA, 58 bp, Artificial Sequence
  Description of Artificial Sequence: Synthetic oligonucleotide
aattcaaaaagtccgcatttcactatcatacctcgaggtatgatagtgaaatgcggac

SEQ ID NO: 2484 - DNA, 58 bp, Artificial Sequence
  Description of Artificial Sequence: Synthetic oligonucleotide
aattcaaaaaccattctcatgccaactattactcgagtaatagttggcatgagaatgg

SEQ ID NO: 2485 - DNA, 58 bp, Artificial Sequence
  Description of Artificial Sequence: Synthetic oligonucleotide
aattcaaaaacacagatgtgaccctataatactcgagtattatagggtcacatctgtg

SEQ ID NO: 2486 - DNA, 58 bp, Artificial Sequence
  Description of Artificial Sequence: Synthetic oligonucleotide
aattcaaaaatgtaaagaagtgtcgtgtatactcgagtatacacgacacttctttaca

SEQ ID NO: 2487 - DNA, 58 bp, Artificial Sequence
  Description of Artificial Sequence: Synthetic oligonucleotide
aattcaaaaaataaccacgacgcgttgaatcctcgaggattcaacgcgtcgtggttat

SEQ ID NO: 2488 - DNA, 58 bp, Artificial Sequence
  Description of Artificial Sequence: Synthetic oligonucleotide
aattcaaaaacctgggacaaatgggaagaatctcgagattcttcccatttgtcccagg

SEQ ID NO: 2489 - DNA, 58 bp, Artificial Sequence
  Description of Artificial Sequence: Synthetic oligonucleotide
aattcaaaaactgggctgtaatctgtctcaactcgagttgagacagattacagcccag

SEQ ID NO: 2490 - DNA, 58 bp, Artificial Sequence
  Description of Artificial Sequence: Synthetic oligonucleotide
aattcaaaaacctgaataacaggaggactttctcgagaaagtcctcctgttattcagg

SEQ ID NO: 2491 - DNA, 58 bp, Artificial Sequence
  Description of Artificial Sequence: Synthetic oligonucleotide
aattcaaaaagcagcagaccttcaatctcttctcgagaagagattgaaggtctgctgc

SEQ ID NO: 2492 - DNA, 58 bp, Artificial Sequence
  Description of Artificial Sequence: Synthetic oligonucleotide
aattcaaaaatgtaaagaagcatcgtgtttactcgagtaaacacgatgcttctttaca

SEQ ID NO: 2493 - DNA, 58 bp, Artificial Sequence
  Description of Artificial Sequence: Synthetic oligonucleotide
aattcaaaaaatgatcctcattgattaatacctcgaggtattaatcaatgaggatcat

SEQ ID NO: 2494 - DNA, 58 bp, Artificial Sequence
  Description of Artificial Sequence: Synthetic oligonucleotide
aattcaaaaacctgaaggacagatatgatttctcgagaaatcatatctgtccttcagg

SEQ ID NO: 2495 - DNA, 58 bp, Artificial Sequence
  Description of Artificial Sequence: Synthetic oligonucleotide
aattcaaaaagcacagtggttaatgtaataactcgagttattacattaaccactgtgc

SEQ ID NO: 2496 - DNA, 58 bp, Artificial Sequence
  Description of Artificial Sequence: Synthetic oligonucleotide
aattcaaaaatatgaccatgacacgatttaactcgagttaaatcgtgtcatggtcata

SEQ ID NO: 2497 - DNA, 58 bp, Artificial Sequence
  Description of Artificial Sequence: Synthetic oligonucleotide
aattcaaaaaccatgctgactgatccattatctcgagataatggatcagtcagcatgg

SEQ ID NO: 2498 - DNA, 58 bp, Artificial Sequence
  Description of Artificial Sequence: Synthetic oligonucleotide
aattcaaaaaacttgggatgagacacttctactcgagtagaagtgtctcatcccaagt

SEQ ID NO: 2499 - DNA, 58 bp, Artificial Sequence
  Description of Artificial Sequence: Synthetic oligonucleotide
aattcaaaaaagtggaagacactcctctgatctcgagatcagaggagtgtcttccact

SEQ ID NO: 2500 - DNA, 58 bp, Artificial Sequence
  Description of Artificial Sequence: Synthetic oligonucleotide
aattcaaaaatcaactgcaagtcaatctgttctcgagaacagattgacttgcagttga

SEQ ID NO: 2501 - DNA, 58 bp, Artificial Sequence
  Description of Artificial Sequence: Synthetic oligonucleotide
aattcaaaaagacagacatgacttcagatttctcgagaaatctgaagtcatgtctgtc

SEQ ID NO: 2502 - DNA, 58 bp, Artificial Sequence
  Description of Artificial Sequence: Synthetic oligonucleotide
aattcaaaaactgtcctccatgaggtgattcctcgaggaatcacctcatggaggacag

SEQ ID NO: 2503 - DNA, 58 bp, Artificial Sequence
  Description of Artificial Sequence: Synthetic oligonucleotide
aattcaaaaaaggcttctagacaaactctatctcgagatagagtttgtctagaagcct

SEQ ID NO: 2504 - DNA, 58 bp, Artificial Sequence
  Description of Artificial Sequence: Synthetic oligonucleotide
aattcaaaaataactatctatagggcttaaactcgagtttaagccctatagatagtta

SEQ ID NO: 2505 - DNA, 58 bp, Artificial Sequence
  Description of Artificial Sequence: Synthetic oligonucleotide
aattcaaaaaccaggaggagtttgatgataactcgagttatcatcaaactcctcctgg

SEQ ID NO: 2506 - DNA, 58 bp, Artificial Sequence
  Description of Artificial Sequence: Synthetic oligonucleotide
aattcaaaaagacctggtacaacacggaaatctcgagatttccgtgttgtaccaggtc

SEQ ID NO: 2507 - DNA, 58 bp, Artificial Sequence
  Description of Artificial Sequence: Synthetic oligonucleotide
aattcaaaaagccaagattcaggaaattattctcgagaataatttcctgaatcttggc

SEQ ID NO: 2508 - DNA, 58 bp, Artificial Sequence
  Description of Artificial Sequence: Synthetic oligonucleotide
aattcaaaaagctctcccgtttgtcatttatctcgagataaatgacaaacgggagagc

SEQ ID NO: 2509 - DNA, 58 bp, Artificial Sequence
  Description of Artificial Sequence: Synthetic oligonucleotide
aattcaaaaaatgaactgtgtcaagtataagctcgagcttatacttgacacagttcat

SEQ ID NO: 2510 - DNA, 58 bp, Artificial Sequence
  Description of Artificial Sequence: Synthetic oligonucleotide
aattcaaaaagagtggaaatttcacctatatctcgagatataggtgaaatttccactc

SEQ ID NO: 2511 - DNA, 58 bp, Artificial Sequence
  Description of Artificial Sequence: Synthetic oligonucleotide
aattcaaaaatgtatatcagcctcgtgtttgctcgagcaaacacgaggctgatataca

SEQ ID NO: 2512 - DNA, 58 bp, Artificial Sequence
  Description of Artificial Sequence: Synthetic oligonucleotide
aattcaaaaagcaaataccacaagatcatttctcgagaaatgatcttgtggtatttgc

SEQ ID NO: 2513 - DNA, 58 bp, Artificial Sequence
  Description of Artificial Sequence: Synthetic oligonucleotide
aattcaaaaaattgaatgggaggcttgaatactcgagtattcaagcctcccattcaat

SEQ ID NO: 2514 - DNA, 58 bp, Artificial Sequence
  Description of Artificial Sequence: Synthetic oligonucleotide
aattcaaaaacctacaaagaagcagcaatttctcgagaaattgctgcttctttgtagg

SEQ ID NO: 2515 - DNA, 58 bp, Artificial Sequence
  Description of Artificial Sequence: Synthetic oligonucleotide
aattcaaaaactaatgtctatcatcagataactcgagttatctgatgatagacattag

SEQ ID NO: 2516 - DNA, 58 bp, Artificial Sequence
  Description of Artificial Sequence: Synthetic oligonucleotide
aattcaaaaaggtagtgataaccttagattactcgagtaatctaaggttatcactacc

SEQ ID NO: 2517 - DNA, 58 bp, Artificial Sequence
  Description of Artificial Sequence: Synthetic oligonucleotide
aattcaaaaaagcctcttcagggcaaatattctcgagaatatttgccctgaagaggct

SEQ ID NO: 2518 - DNA, 58 bp, Artificial Sequence
  Description of Artificial Sequence: Synthetic oligonucleotide
aattcaaaaacatagagtggtaatacaatttctcgagaaattgtattaccactctatg

SEQ ID NO: 2519 - DNA, 58 bp, Artificial Sequence
  Description of Artificial Sequence: Synthetic oligonucleotide
aattcaaaaaggttgtcctgcctgcaatattctcgagaatattgcaggcaggacaacc

SEQ ID NO: 2520 - DNA, 58 bp, Artificial Sequence
  Description of Artificial Sequence: Synthetic oligonucleotide
aattcaaaaacattcagatgtagcggataatctcgagattatccgctacatctgaatg

SEQ ID NO: 2521 - DNA, 58 bp, Artificial Sequence
  Description of Artificial Sequence: Synthetic oligonucleotide
aattcaaaaatgttactgccaggacccatatctcgagatatgggtcctggcagtaaca

SEQ ID NO: 2522 - DNA, 58 bp, Artificial Sequence
  Description of Artificial Sequence: Synthetic oligonucleotide
aattcaaaaaacgagcaggaagtcgattatgctcgagcataatcgacttcctgctcgt

SEQ ID NO: 2523 - DNA, 58 bp, Artificial Sequence
  Description of Artificial Sequence: Synthetic oligonucleotide
aattcaaaaacatgaaccctatcgtatattgctcgagcaatatacgatagggttcatg

SEQ ID NO: 2524 - DNA, 58 bp, Artificial Sequence
  Description of Artificial Sequence: Synthetic oligonucleotide
aattcaaaaacggaagtgagatccagtataactcgagttatactggatctcacttccg

SEQ ID NO: 2525 - DNA, 58 bp, Artificial Sequence
  Description of Artificial Sequence: Synthetic oligonucleotide
aattcaaaaagagattgtggctacgcaaatgctcgagcatttgcgtagccacaatctc

SEQ ID NO: 2526 - DNA, 58 bp, Artificial Sequence
  Description of Artificial Sequence: Synthetic oligonucleotide
aattcaaaaactgttcagattcaagattattctcgagaataatcttgaatctgaacag

SEQ ID NO: 2527 - DNA, 58 bp, Artificial Sequence
  Description of Artificial Sequence: Synthetic oligonucleotide
aattcaaaaatcagccaacacaccttcaaatctcgagatttgaaggtgtgttggctga

SEQ ID NO: 2528 - DNA, 58 bp, Artificial Sequence
  Description of Artificial Sequence: Synthetic oligonucleotide
aattcaaaaactcacgcgagacctcaaatatctcgagatatttgaggtctcgcgtgag

SEQ ID NO: 2529 - DNA, 58 bp, Artificial Sequence
  Description of Artificial Sequence: Synthetic oligonucleotide
aattcaaaaagccacattggcaggttcaaatctcgagatttgaacctgccaatgtggc

SEQ ID NO: 2530 - DNA, 58 bp, Artificial Sequence
  Description of Artificial Sequence: Synthetic oligonucleotide
aattcaaaaagagttgcagctctcctgtcttctcgagaagacaggagagctgcaactc

SEQ ID NO: 2531 - DNA, 58 bp, Artificial Sequence
  Description of Artificial Sequence: Synthetic oligonucleotide
aattcaaaaaagggccaaagatgccttagaactcgagttctaaggcatctttggccct

SEQ ID NO: 2532 - DNA, 58 bp, Artificial Sequence
  Description of Artificial Sequence: Synthetic oligonucleotide
aattcaaaaagcctttaagagggccaaagatctcgagatctttggccctcttaaaggc

SEQ ID NO: 2533 - DNA, 58 bp, Artificial Sequence
  Description of Artificial Sequence: Synthetic oligonucleotide
aattcaaaaatgccacatagcccagttcaagctcgagcttgaactgggctatgtggca

SEQ ID NO: 2534 - DNA, 58 bp, Artificial Sequence
  Description of Artificial Sequence: Synthetic oligonucleotide
aattcaaaaaagactcttatttcggctttaactcgagttaaagccgaaataagagtct

SEQ ID NO: 2535 - DNA, 58 bp, Artificial Sequence
  Description of Artificial Sequence: Synthetic oligonucleotide
aattcaaaaatcagtccctaagatgttatttctcgagaaataacatcttagggactga

SEQ ID NO: 2536 - DNA, 58 bp, Artificial Sequence
  Description of Artificial Sequence: Synthetic oligonucleotide
aattcaaaaacggtatattaagccagtatatctcgagatatactggcttaatataccg

SEQ ID NO: 2537 - DNA, 58 bp, Artificial Sequence
  Description of Artificial Sequence: Synthetic oligonucleotide
aattcaaaaaagcttctctgtgaacgatttactcgagtaaatcgttcacagagaagct

SEQ ID NO: 2538 - DNA, 58 bp, Artificial Sequence
  Description of Artificial Sequence: Synthetic oligonucleotide
aattcaaaaagcaggtgaagaatgcctttaactcgagttaaaggcattcttcacctgc

SEQ ID NO: 2539 - DNA, 58 bp, Artificial Sequence
  Description of Artificial Sequence: Synthetic oligonucleotide
aattcaaaaagctggacaacttgttgttaaactcgagtttaacaacaagttgtccagc

SEQ ID NO: 2540 - DNA, 58 bp, Artificial Sequence
  Description of Artificial Sequence: Synthetic oligonucleotide
aattcaaaaatctgtcgcttcccgaagtaacctcgaggttacttcgggaagcgacaga

SEQ ID NO: 2541 - DNA, 58 bp, Artificial Sequence
  Description of Artificial Sequence: Synthetic oligonucleotide
aattcaaaaagaaacaggatcctctagaaatctcgagatttctagaggatcctgtttc

SEQ ID NO: 2542 - DNA, 58 bp, Artificial Sequence
  Description of Artificial Sequence: Synthetic oligonucleotide
aattcaaaaagaactctttcctgtatcataactcgagttatgatacaggaaagagttc

SEQ ID NO: 2543 - DNA, 58 bp, Artificial Sequence
  Description of Artificial Sequence: Synthetic oligonucleotide
aattcaaaaaatatccacttgagggcgatttctcgagaaatcgccctcaagtggatat

SEQ ID NO: 2544 - DNA, 58 bp, Artificial Sequence
  Description of Artificial Sequence: Synthetic oligonucleotide
aattcaaaaaccttccaaagccagatcttatctcgagataagatctggctttggaagg

SEQ ID NO: 2545 - DNA, 58 bp, Artificial Sequence
  Description of Artificial Sequence: Synthetic oligonucleotide
aattcaaaaatgcacagctgagggacaaattctcgagaatttgtccctcagctgtgca

SEQ ID NO: 2546 - DNA, 58 bp, Artificial Sequence
  Description of Artificial Sequence: Synthetic oligonucleotide
aattcaaaaacggcagattccacctataattctcgagaattataggtggaatctgccg

SEQ ID NO: 2547 - DNA, 58 bp, Artificial Sequence
  Description of Artificial Sequence: Synthetic oligonucleotide
aattcaaaaatcggcagattccacctataatctcgagattataggtggaatctgccga

SEQ ID NO: 2548 - DNA, 58 bp, Artificial Sequence
  Description of Artificial Sequence: Synthetic oligonucleotide
aattcaaaaatggagccagtaccggattaatctcgagattaatccggtactggctcca

SEQ ID NO: 2549 - DNA, 58 bp, Artificial Sequence
  Description of Artificial Sequence: Synthetic oligonucleotide
aattcaaaaatgatacctctgatcaagtattctcgagaatacttgatcagaggtatca

SEQ ID NO: 2550 - DNA, 58 bp, Artificial Sequence
  Description of Artificial Sequence: Synthetic oligonucleotide
aattcaaaaacctgtgccttagtagtatttactcgagtaaatactactaaggcacagg

SEQ ID NO: 2551 - DNA, 58 bp, Artificial Sequence
  Description of Artificial Sequence: Synthetic oligonucleotide
aattcaaaaacctgtttaccattggaattaactcgagttaattccaatggtaaacagg

SEQ ID NO: 2552 - DNA, 58 bp, Artificial Sequence
  Description of Artificial Sequence: Synthetic oligonucleotide
aattcaaaaagaatttggtccactgatatttctcgagaaatatcagtggaccaaattc

SEQ ID NO: 2553 - DNA, 58 bp, Artificial Sequence
  Description of Artificial Sequence: Synthetic oligonucleotide
aattcaaaaaccatgggccttcatgctatttctcgagaaatagcatgaaggcccatgg

SEQ ID NO: 2554 - DNA, 58 bp, Artificial Sequence
  Description of Artificial Sequence: Synthetic oligonucleotide
aattcaaaaattagatgctaaatgctcattgctcgagcaatgagcatttagcatctaa

SEQ ID NO: 2555 - DNA, 58 bp, Artificial Sequence
  Description of Artificial Sequence: Synthetic oligonucleotide
aattcaaaaacagctctacaactcagttaaactcgagtttaactgagttgtagagctg

SEQ ID NO: 2556 - DNA, 58 bp, Artificial Sequence
  Description of Artificial Sequence: Synthetic oligonucleotide
aattcaaaaagtcatctcctcgaaccaatttctcgagaaattggttcgaggagatgac

SEQ ID NO: 2557 - DNA, 58 bp, Artificial Sequence
  Description of Artificial Sequence: Synthetic oligonucleotide
aattcaaaaaccaacgggaccaccatgtattctcgagaatacatggtggtcccgttgg

SEQ ID NO: 2558 - DNA, 58 bp, Artificial Sequence
  Description of Artificial Sequence: Synthetic oligonucleotide
aattcaaaaaacttcgaaagcatcattatttctcgagaaataatgatgctttcgaagt

SEQ ID NO: 2559 - DNA, 58 bp, Artificial Sequence
  Description of Artificial Sequence: Synthetic oligonucleotide
aattcaaaaaattgaagttgcagattcatttctcgagaaatgaatctgcaacttcaat

SEQ ID NO: 2560 - DNA, 58 bp, Artificial Sequence
  Description of Artificial Sequence: Synthetic oligonucleotide
aattcaaaaacctgctcttacatttaaagaactcgagttctttaaatgtaagagcagg

SEQ ID NO: 2561 - DNA, 58 bp, Artificial Sequence
  Description of Artificial Sequence: Synthetic oligonucleotide
aattcaaaaagaagatcttattcaatctatgctcgagcatagattgaataagatcttc

SEQ ID NO: 2562 - DNA, 58 bp, Artificial Sequence
  Description of Artificial Sequence: Synthetic oligonucleotide
aattcaaaaataagggtgatagtcaaattatctcgagataatttgactatcaccctta

SEQ ID NO: 2563 - DNA, 58 bp, Artificial Sequence
  Description of Artificial Sequence: Synthetic oligonucleotide
aattcaaaaacactctgctgcttagacataactcgagttatgtctaagcagcagagtg

SEQ ID NO: 2564 - DNA, 58 bp, Artificial Sequence
  Description of Artificial Sequence: Synthetic oligonucleotide
aattcaaaaatgggaccacgtgagatcattcctcgaggaatgatctcacgtggtccca

SEQ ID NO: 2565 - DNA, 58 bp, Artificial Sequence
  Description of Artificial Sequence: Synthetic oligonucleotide
aattcaaaaagttctggatgaagcaacattactcgagtaatgttgcttcatccagaac

SEQ ID NO: 2566 - DNA, 58 bp, Artificial Sequence
  Description of Artificial Sequence: Synthetic oligonucleotide
aattcaaaaacccaaacagtgacatttatttctcgagaaataaatgtcactgtttggg

SEQ ID NO: 2567 - DNA, 58 bp, Artificial Sequence
  Description of Artificial Sequence: Synthetic oligonucleotide
aattcaaaaaatcagttctgcctaggtaaatctcgagatttacctaggcagaactgat

SEQ ID NO: 2568 - DNA, 58 bp, Artificial Sequence
  Description of Artificial Sequence: Synthetic oligonucleotide
aattcaaaaagagctatttaaggatctatttctcgagaaatagatccttaaatagctc

SEQ ID NO: 2569 - DNA, 58 bp, Artificial Sequence
  Description of Artificial Sequence: Synthetic oligonucleotide
aattcaaaaaggtcaacctgaacatccataactcgagttatggatgttcaggttgacc

SEQ ID NO: 2570 - DNA, 58 bp, Artificial Sequence
  Description of Artificial Sequence: Synthetic oligonucleotide
aattcaaaaatatgcccgcatggaggagtatctcgagatactcctccatgcgggcata

SEQ ID NO: 2571 - DNA, 58 bp, Artificial Sequence
  Description of Artificial Sequence: Synthetic oligonucleotide
aattcaaaaagtgtcacggatgaaaccgtatctcgagatacggtttcatccgtgacac

SEQ ID NO: 2572 - DNA, 58 bp, Artificial Sequence
  Description of Artificial Sequence: Synthetic oligonucleotide
aattcaaaaagcagctgtggatgtccaacaactcgagttgttggacatccacagctgc

SEQ ID NO: 2573 - DNA, 58 bp, Artificial Sequence
  Description of Artificial Sequence: Synthetic oligonucleotide
aattcaaaaagcacctcttccagcccttaaactcgagtttaagggctggaagaggtgc

SEQ ID NO: 2574 - DNA, 58 bp, Artificial Sequence
  Description of Artificial Sequence: Synthetic oligonucleotide
aattcaaaaactttgccttccacaccgagttctcgagaactcggtgtggaaggcaaag

SEQ ID NO: 2575 - DNA, 58 bp, Artificial Sequence
  Description of Artificial Sequence: Synthetic oligonucleotide
aattcaaaaaatctccagcctcagtagttggctcgagccaactactgaggctggagat

SEQ ID NO: 2576 - DNA, 58 bp, Artificial Sequence
  Description of Artificial Sequence: Synthetic oligonucleotide
aattcaaaaaagagctactctgttacatttcctcgaggaaatgtaacagagtagctct

SEQ ID NO: 2577 - DNA, 58 bp, Artificial Sequence
  Description of Artificial Sequence: Synthetic oligonucleotide
aattcaaaaacaaagagatagggacgcatatctcgagatatgcgtccctatctctttg

SEQ ID NO: 2578 - DNA, 58 bp, Artificial Sequence
  Description of Artificial Sequence: Synthetic oligonucleotide
aattcaaaaaagacagcatcaactccagcatctcgagatgctggagttgatgctgtct

SEQ ID NO: 2579 - DNA, 58 bp, Artificial Sequence
  Description of Artificial Sequence: Synthetic oligonucleotide
aattcaaaaatcatccaccatgtgcagtaagctcgagcttactgcacatggtggatga

SEQ ID NO: 2580 - DNA, 58 bp, Artificial Sequence
  Description of Artificial Sequence: Synthetic oligonucleotide
aattcaaaaagtacttgctgctgtcgatattctcgagaatatcgacagcagcaagtac

SEQ ID NO: 2581 - DNA, 58 bp, Artificial Sequence
  Description of Artificial Sequence: Synthetic oligonucleotide
aattcaaaaacgtttccatgtcacgtaacatctcgagatgttacgtgacatggaaacg

SEQ ID NO: 2582 - DNA, 58 bp, Artificial Sequence
  Description of Artificial Sequence: Synthetic oligonucleotide
aattcaaaaacccggaccatatttattataactcgagttataataaatatggtccggg

SEQ ID NO: 2583 - DNA, 58 bp, Artificial Sequence
  Description of Artificial Sequence: Synthetic oligonucleotide
aattcaaaaatgattctgactgtagagataactcgagttatctctacagtcagaatca

SEQ ID NO: 2584 - DNA, 58 bp, Artificial Sequence
  Description of Artificial Sequence: Synthetic oligonucleotide
aattcaaaaatggcaagcttgaatctaaattctcgagaatttagattcaagcttgcca

SEQ ID NO: 2585 - DNA, 58 bp, Artificial Sequence
  Description of Artificial Sequence: Synthetic oligonucleotide
aattcaaaaaggtcccttctctcaccaaattctcgagaatttggtgagagaagggacc

SEQ ID NO: 2586 - DNA, 58 bp, Artificial Sequence
  Description of Artificial Sequence: Synthetic oligonucleotide
aattcaaaaatcccatgtctctgctcatttactcgagtaaatgagcagagacatggga

SEQ ID NO: 2587 - DNA, 58 bp, Artificial Sequence
  Description of Artificial Sequence: Synthetic oligonucleotide
aattcaaaaactgggcaatggttccttcattctcgagaatgaaggaaccattgcccag

SEQ ID NO: 2588 - DNA, 58 bp, Artificial Sequence
  Description of Artificial Sequence: Synthetic oligonucleotide
aattcaaaaagtccacgctgctgccattaaactcgagtttaatggcagcagcgtggac

SEQ ID NO: 2589 - DNA, 58 bp, Artificial Sequence
  Description of Artificial Sequence: Synthetic oligonucleotide
aattcaaaaatccacagacatgcaccatatactcgagtatatggtgcatgtctgtgga

SEQ ID NO: 2590 - DNA, 58 bp, Artificial Sequence
  Description of Artificial Sequence: Synthetic oligonucleotide
aattcaaaaatgatgacaaggaacctgtatactcgagtatacaggttccttgtcatca

SEQ ID NO: 2591 - DNA, 58 bp, Artificial Sequence
  Description of Artificial Sequence: Synthetic oligonucleotide
aattcaaaaagtggaaccaacactaacatatctcgagatatgttagtgttggttccac

SEQ ID NO: 2592 - DNA, 58 bp, Artificial Sequence
  Description of Artificial Sequence: Synthetic oligonucleotide
aattcaaaaagccctcaatcaaagtataattctcgagaattatactttgattgagggc

SEQ ID NO: 2593 - DNA, 58 bp, Artificial Sequence
  Description of Artificial Sequence: Synthetic oligonucleotide
aattcaaaaatattacagatgggcaaattaactcgagttaatttgcccatctgtaata

SEQ ID NO: 2594 - DNA, 58 bp, Artificial Sequence
  Description of Artificial Sequence: Synthetic oligonucleotide
aattcaaaaaatcaataacaagctggaatttctcgagaaattccagcttgttattgat

SEQ ID NO: 2595 - DNA, 58 bp, Artificial Sequence
  Description of Artificial Sequence: Synthetic oligonucleotide
aattcaaaaaagcaaccgcttccctatttatctcgagataaatagggaagcggttgct

SEQ ID NO: 2596 - DNA, 58 bp, Artificial Sequence
  Description of Artificial Sequence: Synthetic oligonucleotide
aattcaaaaactgacttcaccatgcaatttgctcgagcaaattgcatggtgaagtcag

SEQ ID NO: 2597 - DNA, 58 bp, Artificial Sequence
  Description of Artificial Sequence: Synthetic oligonucleotide
aattcaaaaatccttgtgggctcagtttaatctcgagattaaactgagcccacaagga

SEQ ID NO: 2598 - DNA, 58 bp, Artificial Sequence
  Description of Artificial Sequence: Synthetic oligonucleotide
aattcaaaaaggtctatggtaggcagaataactcgagttattctgcctaccatagacc

SEQ ID NO: 2599 - DNA, 58 bp, Artificial Sequence
  Description of Artificial Sequence: Synthetic oligonucleotide
aattcaaaaatgcagaccagaaggctctatactcgagtatagagccttctggtctgca

SEQ ID NO: 2600 - DNA, 58 bp, Artificial Sequence
  Description of Artificial Sequence: Synthetic oligonucleotide
aattcaaaaagccaagaatacacatggtatactcgagtataccatgtgtattcttggc

SEQ ID NO: 2601 - DNA, 58 bp, Artificial Sequence
  Description of Artificial Sequence: Synthetic oligonucleotide
aattcaaaaaataatgcacaagccatatttactcgagtaaatatggcttgtgcattat

SEQ ID NO: 2602 - DNA, 58 bp, Artificial Sequence
  Description of Artificial Sequence: Synthetic oligonucleotide
aattcaaaaatggtatagatgcagcatatatctcgagatatatgctgcatctatacca

SEQ ID NO: 2603 - DNA, 58 bp, Artificial Sequence
  Description of Artificial Sequence: Synthetic oligonucleotide
aattcaaaaacaatcccgtgtaaggtgtttcctcgaggaaacaccttacacgggattg

SEQ ID NO: 2604 - DNA, 58 bp, Artificial Sequence
  Description of Artificial Sequence: Synthetic oligonucleotide
aattcaaaaagaccattcctgtgatcatttcctcgaggaaatgatcacaggaatggtc

SEQ ID NO: 2605 - DNA, 58 bp, Artificial Sequence
  Description of Artificial Sequence: Synthetic oligonucleotide
aattcaaaaacgttcatctcatacccgcaaactcgagtttgcgggtatgagatgaacg

SEQ ID NO: 2606 - DNA, 58 bp, Artificial Sequence
  Description of Artificial Sequence: Synthetic oligonucleotide
aattcaaaaacaaagcaagcggctgattattctcgagaataatcagccgcttgctttg

SEQ ID NO: 2607 - DNA, 58 bp, Artificial Sequence
  Description of Artificial Sequence: Synthetic oligonucleotide
aattcaaaaagccagcgttctccttcataaactcgagtttatgaaggagaacgctggc

SEQ ID NO: 2608 - DNA, 58 bp, Artificial Sequence
  Description of Artificial Sequence: Synthetic oligonucleotide
aattcaaaaatcaagctcctgacggtcattactcgagtaatgaccgtcaggagcttga

SEQ ID NO: 2609 - DNA, 58 bp, Artificial Sequence
  Description of Artificial Sequence: Synthetic oligonucleotide
aattcaaaaattacaccgtggattggtattactcgagtaataccaatccacggtgtaa

SEQ ID NO: 2610 - DNA, 58 bp, Artificial Sequence
  Description of Artificial Sequence: Synthetic oligonucleotide
aattcaaaaaagttgctgattctggtatttactcgagtaaataccagaatcagcaact

SEQ ID NO: 2611 - DNA, 58 bp, Artificial Sequence
  Description of Artificial Sequence: Synthetic oligonucleotide
aattcaaaaacgtgaaggaagaggatttattctcgagaataaatcctcttccttcacg

SEQ ID NO: 2612 - DNA, 58 bp, Artificial Sequence
  Description of Artificial Sequence: Synthetic oligonucleotide
aattcaaaaagcaaggaccaaatgtcaatttctcgagaaattgacatttggtccttgc

SEQ ID NO: 2613 - DNA, 58 bp, Artificial Sequence
  Description of Artificial Sequence: Synthetic oligonucleotide
aattcaaaaacgtcatggtcaccaaattctactcgagtagaatttggtgaccatgacg

SEQ ID NO: 2614 - DNA, 58 bp, Artificial Sequence
  Description of Artificial Sequence: Synthetic oligonucleotide
aattcaaaaactgcctccagaatggtctttcctcgaggaaagaccattctggaggcag

SEQ ID NO: 2615 - DNA, 58 bp, Artificial Sequence
  Description of Artificial Sequence: Synthetic oligonucleotide
aattcaaaaagctacctattgtaactattatctcgagataatagttacaataggtagc

SEQ ID NO: 2616 - DNA, 58 bp, Artificial Sequence
  Description of Artificial Sequence: Synthetic oligonucleotide
aattcaaaaacagctacaactggagcatttactcgagtaaatgctccagttgtagctg

SEQ ID NO: 2617 - DNA, 58 bp, Artificial Sequence
  Description of Artificial Sequence: Synthetic oligonucleotide
aattcaaaaatgctggatttacagatgatttctcgagaaatcatctgtaaatccagca

SEQ ID NO: 2618 - DNA, 58 bp, Artificial Sequence
  Description of Artificial Sequence: Synthetic oligonucleotide
aattcaaaaactgatgctctgtgagatatttctcgagaaatatctcacagagcatcag

SEQ ID NO: 2619 - DNA, 58 bp, Artificial Sequence
  Description of Artificial Sequence: Synthetic oligonucleotide
aattcaaaaatggtcacagtgtatcttatttctcgagaaataagatacactgtgacca

SEQ ID NO: 2620 - DNA, 58 bp, Artificial Sequence
  Description of Artificial Sequence: Synthetic oligonucleotide
aattcaaaaaggactgaagacactcaatttgctcgagcaaattgagtgtcttcagtcc

SEQ ID NO: 2621 - DNA, 58 bp, Artificial Sequence
  Description of Artificial Sequence: Synthetic oligonucleotide
aattcaaaaaccagtattatgccaaagttaactcgagttaactttggcataatactgg

SEQ ID NO: 2622 - DNA, 58 bp, Artificial Sequence
  Description of Artificial Sequence: Synthetic oligonucleotide
aattcaaaaagagggtcttcaaggagttaaactcgagtttaactccttgaagaccctc

SEQ ID NO: 2623 - DNA, 58 bp, Artificial Sequence
  Description of Artificial Sequence: Synthetic oligonucleotide
aattcaaaaagcttcgcatttgatggaaattctcgagaatttccatcaaatgcgaagc

SEQ ID NO: 2624 - DNA, 58 bp, Artificial Sequence
  Description of Artificial Sequence: Synthetic oligonucleotide
aattcaaaaacagtgtactattctgtcgaatctcgagattcgacagaatagtacactg

SEQ ID NO: 2625 - DNA, 58 bp, Artificial Sequence
  Description of Artificial Sequence: Synthetic oligonucleotide
aattcaaaaaccagaataatccttgagagaactcgagttctctcaaggattattctgg

SEQ ID NO: 2626 - DNA, 58 bp, Artificial Sequence
  Description of Artificial Sequence: Synthetic oligonucleotide
aattcaaaaactctgtactctcaaccaacatctcgagatgttggttgagagtacagag

SEQ ID NO: 2627 - DNA, 58 bp, Artificial Sequence
  Description of Artificial Sequence: Synthetic oligonucleotide
aattcaaaaaaggaaaccaccttccacaaatctcgagatttgtggaaggtggtttcct

SEQ ID NO: 2628 - DNA, 58 bp, Artificial Sequence
  Description of Artificial Sequence: Synthetic oligonucleotide
aattcaaaaaatgacttggtccctgaatttcctcgaggaaattcagggaccaagtcat

SEQ ID NO: 2629 - DNA, 58 bp, Artificial Sequence
  Description of Artificial Sequence: Synthetic oligonucleotide
aattcaaaaactttcagaaggcccaactaaactcgagtttagttgggccttctgaaag

SEQ ID NO: 2630 - DNA, 58 bp, Artificial Sequence
  Description of Artificial Sequence: Synthetic oligonucleotide
aattcaaaaaaggctaagcacatgtcatattctcgagaatatgacatgtgcttagcct

SEQ ID NO: 2631 - DNA, 58 bp, Artificial Sequence
  Description of Artificial Sequence: Synthetic oligonucleotide
aattcaaaaagtttccataatcagtactttactcgagtaaagtactgattatggaaac

SEQ ID NO: 2632 - DNA, 58 bp, Artificial Sequence
  Description of Artificial Sequence: Synthetic oligonucleotide
aattcaaaaaagactttctaagcatagatatctcgagatatctatgcttagaaagtct

SEQ ID NO: 2633 - DNA, 58 bp, Artificial Sequence
  Description of Artificial Sequence: Synthetic oligonucleotide
aattcaaaaaggacactttctagtcctaaacctcgaggtttaggactagaaagtgtcc

SEQ ID NO: 2634 - DNA, 58 bp, Artificial Sequence
  Description of Artificial Sequence: Synthetic oligonucleotide
aattcaaaaaagggacaccacagtacctaaactcgagtttaggtactgtggtgtccct

SEQ ID NO: 2635 - DNA, 58 bp, Artificial Sequence
  Description of Artificial Sequence: Synthetic oligonucleotide
aattcaaaaactgtccgagatcacctacttactcgagtaagtaggtgatctcggacag

SEQ ID NO: 2636 - DNA, 58 bp, Artificial Sequence
  Description of Artificial Sequence: Synthetic oligonucleotide
aattcaaaaaagacatacaggaaccttattactcgagtaataaggttcctgtatgtct

SEQ ID NO: 2637 - DNA, 58 bp, Artificial Sequence
  Description of Artificial Sequence: Synthetic oligonucleotide
aattcaaaaactcgtgtttgaaggatcttatctcgagataagatccttcaaacacgag

SEQ ID NO: 2638 - DNA, 58 bp, Artificial Sequence
  Description of Artificial Sequence: Synthetic oligonucleotide
aattcaaaaatgctccaaatttaccatatagctcgagctatatggtaaatttggagca

SEQ ID NO: 2639 - DNA, 58 bp, Artificial Sequence
  Description of Artificial Sequence: Synthetic oligonucleotide
aattcaaaaaagctgctaggatcggatatttctcgagaaatatccgatcctagcagct

SEQ ID NO: 2640 - DNA, 58 bp, Artificial Sequence
  Description of Artificial Sequence: Synthetic oligonucleotide
aattcaaaaactgtgagccaacaggttaattctcgagaattaacctgttggctcacag

SEQ ID NO: 2641 - DNA, 58 bp, Artificial Sequence
  Description of Artificial Sequence: Synthetic oligonucleotide
aattcaaaaaggatccaccagggtctgatttctcgagaaatcagaccctggtggatcc

SEQ ID NO: 2642 - DNA, 58 bp, Artificial Sequence
  Description of Artificial Sequence: Synthetic oligonucleotide
aattcaaaaactttctttgattgggatatttctcgagaaatatcccaatcaaagaaag

SEQ ID NO: 2643 - DNA, 58 bp, Artificial Sequence
  Description of Artificial Sequence: Synthetic oligonucleotide
aattcaaaaatatctcacctcaagctatattctcgagaatatagcttgaggtgagata

SEQ ID NO: 2644 - DNA, 58 bp, Artificial Sequence
  Description of Artificial Sequence: Synthetic oligonucleotide
aattcaaaaacgacaatactacagttgtatactcgagtatacaactgtagtattgtcg

SEQ ID NO: 2645 - DNA, 58 bp, Artificial Sequence
  Description of Artificial Sequence: Synthetic oligonucleotide
aattcaaaaacacaggcggtttctgctattcctcgaggaatagcagaaaccgcctgtg

SEQ ID NO: 2646 - DNA, 58 bp, Artificial Sequence
  Description of Artificial Sequence: Synthetic oligonucleotide
aattcaaaaagtcaggactctgaagtcattcctcgaggaatgacttcagagtcctgac

SEQ ID NO: 2647 - DNA, 58 bp, Artificial Sequence
  Description of Artificial Sequence: Synthetic oligonucleotide
aattcaaaaatcggatgctgagagctgttacctcgaggtaacagctctcagcatccga

SEQ ID NO: 2648 - DNA, 58 bp, Artificial Sequence
  Description of Artificial Sequence: Synthetic oligonucleotide
aattcaaaaaacaggcactttctagatatttctcgagaaatatctagaaagtgcctgt

SEQ ID NO: 2649 - DNA, 58 bp, Artificial Sequence
  Description of Artificial Sequence: Synthetic oligonucleotide
aattcaaaaaccacaaccagactgtcttctactcgagtagaagacagtctggttgtgg

SEQ ID NO: 2650 - DNA, 58 bp, Artificial Sequence
  Description of Artificial Sequence: Synthetic oligonucleotide
aattcaaaaatcctgtagggccagtgaagatctcgagatcttcactggccctacagga

SEQ ID NO: 2651 - DNA, 58 bp, Artificial Sequence
  Description of Artificial Sequence: Synthetic oligonucleotide
aattcaaaaaagctgttgacgctctctatatctcgagatatagagagcgtcaacagct

SEQ ID NO: 2652 - DNA, 58 bp, Artificial Sequence
  Description of Artificial Sequence: Synthetic oligonucleotide
aattcaaaaaagtacattgtgtcaacttaatctcgagattaagttgacacaatgtact

SEQ ID NO: 2653 - DNA, 58 bp, Artificial Sequence
  Description of Artificial Sequence: Synthetic oligonucleotide
aattcaaaaacgattccagaagaccgcataactcgagttatgcggtcttctggaatcg

SEQ ID NO: 2654 - DNA, 58 bp, Artificial Sequence
  Description of Artificial Sequence: Synthetic oligonucleotide
aattcaaaaaactccttggagctcgtcttatctcgagataagacgagctccaaggagt

SEQ ID NO: 2655 - DNA, 58 bp, Artificial Sequence
  Description of Artificial Sequence: Synthetic oligonucleotide
aattcaaaaaactttaggactggagtcttggctcgagccaagactccagtcctaaagt

SEQ ID NO: 2656 - DNA, 58 bp, Artificial Sequence
  Description of Artificial Sequence: Synthetic oligonucleotide
aattcaaaaacatcatcagccttggacaaggctcgagccttgtccaaggctgatgatg

SEQ ID NO: 2657 - DNA, 58 bp, Artificial Sequence
  Description of Artificial Sequence: Synthetic oligonucleotide
aattcaaaaacctcgtcacaacaacagatttctcgagaaatctgttgttgtgacgagg

SEQ ID NO: 2658 - DNA, 58 bp, Artificial Sequence
  Description of Artificial Sequence: Synthetic oligonucleotide
aattcaaaaaaccctatacaactggacattgctcgagcaatgtccagttgtatagggt

SEQ ID NO: 2659 - DNA, 58 bp, Artificial Sequence
  Description of Artificial Sequence: Synthetic oligonucleotide
aattcaaaaaactcggaacacaacgaaacaactcgagttgtttcgttgtgttccgagt

SEQ ID NO: 2660 - DNA, 58 bp, Artificial Sequence
  Description of Artificial Sequence: Synthetic oligonucleotide
aattcaaaaaagtcccagacctggtggatttctcgagaaatccaccaggtctgggact

SEQ ID NO: 2661 - DNA, 58 bp, Artificial Sequence
  Description of Artificial Sequence: Synthetic oligonucleotide
aattcaaaaagacccacagatgcaacataagctcgagcttatgttgcatctgtgggtc

SEQ ID NO: 2662 - DNA, 58 bp, Artificial Sequence
  Description of Artificial Sequence: Synthetic oligonucleotide
aattcaaaaaccagacacccagtatgagtttctcgagaaactcatactgggtgtctgg

SEQ ID NO: 2663 - DNA, 58 bp, Artificial Sequence
  Description of Artificial Sequence: Synthetic oligonucleotide
aattcaaaaatcgtgttcggagccgctttaactcgagttaaagcggctccgaacacga

SEQ ID NO: 2664 - DNA, 58 bp, Artificial Sequence
  Description of Artificial Sequence: Synthetic oligonucleotide
aattcaaaaaccaacctcactctgcattattctcgagaataatgcagagtgaggttgg

SEQ ID NO: 2665 - DNA, 58 bp, Artificial Sequence
  Description of Artificial Sequence: Synthetic oligonucleotide
aattcaaaaattggctccatgggattgattactcgagtaatcaatcccatggagccaa

SEQ ID NO: 2666 - DNA, 58 bp, Artificial Sequence
  Description of Artificial Sequence: Synthetic oligonucleotide
aattcaaaaattatcccattgagactatttactcgagtaaatagtctcaatgggataa

SEQ ID NO: 2667 - DNA, 58 bp, Artificial Sequence
  Description of Artificial Sequence: Synthetic oligonucleotide
aattcaaaaacggcatcagatgaattgttaactcgagttaacaattcatctgatgccg

SEQ ID NO: 2668 - DNA, 58 bp, Artificial Sequence
  Description of Artificial Sequence: Synthetic oligonucleotide
aattcaaaaagcaattgagagcattcttaaactcgagtttaagaatgctctcaattgc

SEQ ID NO: 2669 - DNA, 58 bp, Artificial Sequence
  Description of Artificial Sequence: Synthetic oligonucleotide
aattcaaaaagcatatctcaagacaatcagactcgagtctgattgtcttgagatatgc

SEQ ID NO: 2670 - DNA, 58 bp, Artificial Sequence
  Description of Artificial Sequence: Synthetic oligonucleotide
aattcaaaaaccaagtgatgatgtacagaaactcgagtttctgtacatcatcacttgg

SEQ ID NO: 2671 - DNA, 58 bp, Artificial Sequence
  Description of Artificial Sequence: Synthetic oligonucleotide
aattcaaaaacctgactatttctcaacagttctcgagaactgttgagaaatagtcagg

SEQ ID NO: 2672 - DNA, 58 bp, Artificial Sequence
  Description of Artificial Sequence: Synthetic oligonucleotide
aattcaaaaacatcaaacgaatgattcaaatctcgagatttgaatcattcgtttgatg

SEQ ID NO: 2673 - DNA, 58 bp, Artificial Sequence
  Description of Artificial Sequence: Synthetic oligonucleotide
aattcaaaaacgcctgtttcatctgatttaactcgagttaaatcagatgaaacaggcg

SEQ ID NO: 2674 - DNA, 58 bp, Artificial Sequence
  Description of Artificial Sequence: Synthetic oligonucleotide
aattcaaaaatttcctgtgtctactactatactcgagtatagtagtagacacaggaaa

SEQ ID NO: 2675 - DNA, 58 bp, Artificial Sequence
  Description of Artificial Sequence: Synthetic oligonucleotide
aattcaaaaatgtcgccctggcatcttaatactcgagtattaagatgccagggcgaca

SEQ ID NO: 2676 - DNA, 58 bp, Artificial Sequence
  Description of Artificial Sequence: Synthetic oligonucleotide
aattcaaaaaagagctcactcctctacttgactcgagtcaagtagaggagtgagctct

SEQ ID NO: 2677 - DNA, 58 bp, Artificial Sequence
  Description of Artificial Sequence: Synthetic oligonucleotide
aattcaaaaaagagctggaggacgacttcaactcgagttgaagtcgtcctccagctct

SEQ ID NO: 2678 - DNA, 58 bp, Artificial Sequence
  Description of Artificial Sequence: Synthetic oligonucleotide
aattcaaaaagagtgctttgcctttggtatactcgagtataccaaaggcaaagcactc

SEQ ID NO: 2679 - DNA, 58 bp, Artificial Sequence
  Description of Artificial Sequence: Synthetic oligonucleotide
aattcaaaaagcactccaactgtgtttcattctcgagaatgaaacacagttggagtgc

SEQ ID NO: 2680 - DNA, 58 bp, Artificial Sequence
  Description of Artificial Sequence: Synthetic oligonucleotide
aattcaaaaacctgttactttaggagagaaactcgagtttctctcctaaagtaacagg

SEQ ID NO: 2681 - DNA, 58 bp, Artificial Sequence
  Description of Artificial Sequence: Synthetic oligonucleotide
aattcaaaaagccgacttcagtacatgaaacctcgaggtttcatgtactgaagtcggc

SEQ ID NO: 2682 - DNA, 58 bp, Artificial Sequence
  Description of Artificial Sequence: Synthetic oligonucleotide
aattcaaaaacagagccctcattgcagtatgctcgagcatactgcaatgagggctctg

SEQ ID NO: 2683 - DNA, 58 bp, Artificial Sequence
  Description of Artificial Sequence: Synthetic oligonucleotide
aattcaaaaaccgtgttgtccctcttgaatgctcgagcattcaagagggacaacacgg

SEQ ID NO: 2684 - DNA, 58 bp, Artificial Sequence
  Description of Artificial Sequence: Synthetic oligonucleotide
aattcaaaaactccagtcactattgccttaactcgagttaaggcaatagtgactggag

SEQ ID NO: 2685 - DNA, 58 bp, Artificial Sequence
  Description of Artificial Sequence: Synthetic oligonucleotide
aattcaaaaattcaggaccagacgctcatagctcgagctatgagcgtctggtcctgaa

SEQ ID NO: 2686 - DNA, 58 bp, Artificial Sequence
  Description of Artificial Sequence: Synthetic oligonucleotide
aattcaaaaactctgcctgatgtgtgctaaactcgagtttagcacacatcaggcagag

SEQ ID NO: 2687 - DNA, 58 bp, Artificial Sequence
  Description of Artificial Sequence: Synthetic oligonucleotide
aattcaaaaaatcctatgctattcgtgattcctcgaggaatcacgaatagcataggat

SEQ ID NO: 2688 - DNA, 58 bp, Artificial Sequence
  Description of Artificial Sequence: Synthetic oligonucleotide
aattcaaaaacctgagtggaaattctttaatctcgagattaaagaatttccactcagg

SEQ ID NO: 2689 - DNA, 58 bp, Artificial Sequence
  Description of Artificial Sequence: Synthetic oligonucleotide
aattcaaaaattggactacataacctgtaaactcgagtttacaggttatgtagtccaa

SEQ ID NO: 2690 - DNA, 58 bp, Artificial Sequence
  Description of Artificial Sequence: Synthetic oligonucleotide
aattcaaaaatgatatcatccagtctttatactcgagtataaagactggatgatatca

SEQ ID NO: 2691 - DNA, 58 bp, Artificial Sequence
  Description of Artificial Sequence: Synthetic oligonucleotide
aattcaaaaacaggagagctgggtggtataactcgagttataccacccagctctcctg

SEQ ID NO: 2692 - DNA, 58 bp, Artificial Sequence
  Description of Artificial Sequence: Synthetic oligonucleotide
aattcaaaaagggaatccagaatccagaaatctcgagatttctggattctggattccc

SEQ ID NO: 2693 - DNA, 58 bp, Artificial Sequence
  Description of Artificial Sequence: Synthetic oligonucleotide
aattcaaaaactcggcattgaaggtgctttactcgagtaaagcaccttcaatgccgag

SEQ ID NO: 2694 - DNA, 58 bp, Artificial Sequence
  Description of Artificial Sequence: Synthetic oligonucleotide
aattcaaaaatggttcccagtttggataaatctcgagatttatccaaactgggaacca

SEQ ID NO: 2695 - DNA, 58 bp, Artificial Sequence
  Description of Artificial Sequence: Synthetic oligonucleotide
aattcaaaaagggaatcattcctgcttaatgctcgagcattaagcaggaatgattccc

SEQ ID NO: 2696 - DNA, 58 bp, Artificial Sequence
  Description of Artificial Sequence: Synthetic oligonucleotide
aattcaaaaactctactgtgacaaggataaactcgagtttatccttgtcacagtagag

SEQ ID NO: 2697 - DNA, 58 bp, Artificial Sequence
  Description of Artificial Sequence: Synthetic oligonucleotide
aattcaaaaatgcacctcctgcaattgtaatctcgagattacaattgcaggaggtgca

SEQ ID NO: 2698 - DNA, 58 bp, Artificial Sequence
  Description of Artificial Sequence: Synthetic oligonucleotide
aattcaaaaagttcacacaaagatcttctttctcgagaaagaagatctttgtgtgaac

SEQ ID NO: 2699 - DNA, 58 bp, Artificial Sequence
  Description of Artificial Sequence: Synthetic oligonucleotide
aattcaaaaaagctgatccgattcctgaaacctcgaggtttcaggaatcggatcagct

SEQ ID NO: 2700 - DNA, 58 bp, Artificial Sequence
  Description of Artificial Sequence: Synthetic oligonucleotide
aattcaaaaaccacggacacaagtgcgatatctcgagatatcgcacttgtgtccgtgg

SEQ ID NO: 2701 - DNA, 58 bp, Artificial Sequence
  Description of Artificial Sequence: Synthetic oligonucleotide
aattcaaaaatagcatgtgccggcaactttgctcgagcaaagttgccggcacatgcta

SEQ ID NO: 2702 - DNA, 58 bp, Artificial Sequence
  Description of Artificial Sequence: Synthetic oligonucleotide
aattcaaaaagcaagagtttcttggtgtaatctcgagattacaccaagaaactcttgc

SEQ ID NO: 2703 - DNA, 58 bp, Artificial Sequence
  Description of Artificial Sequence: Synthetic oligonucleotide
aattcaaaaagggtactgtggaaagactattctcgagaatagtctttccacagtaccc

SEQ ID NO: 2704 - DNA, 58 bp, Artificial Sequence
  Description of Artificial Sequence: Synthetic oligonucleotide
aattcaaaaagaaagagtcaggccttaatttctcgagaaattaaggcctgactctttc

SEQ ID NO: 2705 - DNA, 58 bp, Artificial Sequence
  Description of Artificial Sequence: Synthetic oligonucleotide
aattcaaaaaatgagcgttaggacactatttctcgagaaatagtgtcctaacgctcat

SEQ ID NO: 2706 - DNA, 58 bp, Artificial Sequence
  Description of Artificial Sequence: Synthetic oligonucleotide
aattcaaaaagagtacctccagaacagatttctcgagaaatctgttctggaggtactc

SEQ ID NO: 2707 - DNA, 58 bp, Artificial Sequence
  Description of Artificial Sequence: Synthetic oligonucleotide
aattcaaaaaatgtgaagctgagttaatttactcgagtaaattaactcagcttcacat

SEQ ID NO: 2708 - DNA, 58 bp, Artificial Sequence
  Description of Artificial Sequence: Synthetic oligonucleotide
aattcaaaaagcaggcacttactactaataactcgagttattagtagtaagtgcctgc

SEQ ID NO: 2709 - DNA, 58 bp, Artificial Sequence
  Description of Artificial Sequence: Synthetic oligonucleotide
aattcaaaaatatcgggctgaacggtcaaagctcgagctttgaccgttcagcccgata

SEQ ID NO: 2710 - DNA, 58 bp, Artificial Sequence
  Description of Artificial Sequence: Synthetic oligonucleotide
aattcaaaaactggaccctgtggatgataaactcgagtttatcatccacagggtccag

SEQ ID NO: 2711 - DNA, 58 bp, Artificial Sequence
  Description of Artificial Sequence: Synthetic oligonucleotide
aattcaaaaaaccgtgcatcgcacctatttactcgagtaaataggtgcgatgcacggt

SEQ ID NO: 2712 - DNA, 58 bp, Artificial Sequence
  Description of Artificial Sequence: Synthetic oligonucleotide
aattcaaaaaacttcagcagtacctataaagctcgagctttataggtactgctgaagt

SEQ ID NO: 2713 - DNA, 58 bp, Artificial Sequence
  Description of Artificial Sequence: Synthetic oligonucleotide
aattcaaaaacggccagaagatctacaattactcgagtaattgtagatcttctggccg

SEQ ID NO: 2714 - DNA, 58 bp, Artificial Sequence
  Description of Artificial Sequence: Synthetic oligonucleotide
aattcaaaaagctcgcaagttgaggcaatttctcgagaaattgcctcaacttgcgagc

SEQ ID NO: 2715 - DNA, 58 bp, Artificial Sequence
  Description of Artificial Sequence: Synthetic oligonucleotide
aattcaaaaagctcactatgaatctattatactcgagtataatagattcatagtgagc

SEQ ID NO: 2716 - DNA, 58 bp, Artificial Sequence
  Description of Artificial Sequence: Synthetic oligonucleotide
aattcaaaaagtgtttcctaaagagactattctcgagaatagtctctttaggaaacac

SEQ ID NO: 2717 - DNA, 58 bp, Artificial Sequence
  Description of Artificial Sequence: Synthetic oligonucleotide
aattcaaaaaaccaccatgcaaacaagatacctcgaggtatcttgtttgcatggtggt

SEQ ID NO: 2718 - DNA, 58 bp, Artificial Sequence
  Description of Artificial Sequence: Synthetic oligonucleotide
aattcaaaaagaacaacaagtgtccatatttctcgagaaatatggacacttgttgttc

SEQ ID NO: 2719 - DNA, 58 bp, Artificial Sequence
  Description of Artificial Sequence: Synthetic oligonucleotide
aattcaaaaactgaagagtcttctggaaattctcgagaatttccagaagactcttcag

SEQ ID NO: 2720 - DNA, 58 bp, Artificial Sequence
  Description of Artificial Sequence: Synthetic oligonucleotide
aattcaaaaacctcggatggaggttactcttctcgagaagagtaacctccatccgagg

SEQ ID NO: 2721 - DNA, 58 bp, Artificial Sequence
  Description of Artificial Sequence: Synthetic oligonucleotide
aattcaaaaagcagcactgtgcttgtatctactcgagtagatacaagcacagtgctgc

SEQ ID NO: 2722 - DNA, 58 bp, Artificial Sequence
  Description of Artificial Sequence: Synthetic oligonucleotide
aattcaaaaatggaggttactctttcaagtactcgagtacttgaaagagtaacctcca

SEQ ID NO: 2723 - DNA, 58 bp, Artificial Sequence
  Description of Artificial Sequence: Synthetic oligonucleotide
aattcaaaaaaggcactttcctacccaattactcgagtaattgggtaggaaagtgcct

SEQ ID NO: 2724 - DNA, 58 bp, Artificial Sequence
  Description of Artificial Sequence: Synthetic oligonucleotide
aattcaaaaagagaatggtgtaccctttattctcgagaataaagggtacaccattctc

SEQ ID NO: 2725 - DNA, 58 bp, Artificial Sequence
  Description of Artificial Sequence: Synthetic oligonucleotide
aattcaaaaaagacgctgcacttcgagatttctcgagaaatctcgaagtgcagcgtct

SEQ ID NO: 2726 - DNA, 58 bp, Artificial Sequence
  Description of Artificial Sequence: Synthetic oligonucleotide
aattcaaaaacaaatggatgcggtgacaaatctcgagatttgtcaccgcatccatttg

SEQ ID NO: 2727 - DNA, 58 bp, Artificial Sequence
  Description of Artificial Sequence: Synthetic oligonucleotide
aattcaaaaagctggaacgactggatcatagctcgagctatgatccagtcgttccagc

SEQ ID NO: 2728 - DNA, 58 bp, Artificial Sequence
  Description of Artificial Sequence: Synthetic oligonucleotide
aattcaaaaatgatgagtacaacatcgtcaactcgagttgacgatgttgtactcatca

SEQ ID NO: 2729 - DNA, 58 bp, Artificial Sequence
  Description of Artificial Sequence: Synthetic oligonucleotide
aattcaaaaatcaaccagactcgtcttgattctcgagaatcaagacgagtctggttga

SEQ ID NO: 2730 - DNA, 58 bp, Artificial Sequence
  Description of Artificial Sequence: Synthetic oligonucleotide
aattcaaaaacaagactgacatacctgacatctcgagatgtcaggtatgtcagtcttg

SEQ ID NO: 2731 - DNA, 58 bp, Artificial Sequence
  Description of Artificial Sequence: Synthetic oligonucleotide
aattcaaaaacaggccagtctcatgttctttctcgagaaagaacatgagactggcctg

SEQ ID NO: 2732 - DNA, 58 bp, Artificial Sequence
  Description of Artificial Sequence: Synthetic oligonucleotide
aattcaaaaactcctctacctggatcataatctcgagattatgatccaggtagaggag

SEQ ID NO: 2733 - DNA, 58 bp, Artificial Sequence
  Description of Artificial Sequence: Synthetic oligonucleotide
aattcaaaaaacctgggctggcataccttaactcgagttaaggtatgccagcccaggt

SEQ ID NO: 2734 - DNA, 58 bp, Artificial Sequence
  Description of Artificial Sequence: Synthetic oligonucleotide
aattcaaaaagcagcccttcctagagcttaactcgagttaagctctaggaagggctgc

SEQ ID NO: 2735 - DNA, 58 bp, Artificial Sequence
  Description of Artificial Sequence: Synthetic oligonucleotide
aattcaaaaaccaacgcttcagtgatcaatcctcgaggattgatcactgaagcgttgg

SEQ ID NO: 2736 - DNA, 58 bp, Artificial Sequence
  Description of Artificial Sequence: Synthetic oligonucleotide
aattcaaaaatgtagaacacatcaagcatttctcgagaaatgcttgatgtgttctaca

SEQ ID NO: 2737 - DNA, 58 bp, Artificial Sequence
  Description of Artificial Sequence: Synthetic oligonucleotide
aattcaaaaacatgatcttgtgacatattatctcgagataatatgtcacaagatcatg

SEQ ID NO: 2738 - DNA, 58 bp, Artificial Sequence
  Description of Artificial Sequence: Synthetic oligonucleotide
aattcaaaaattgaagtgtaccctagcatttctcgagaaatgctagggtacacttcaa

SEQ ID NO: 2739 - DNA, 58 bp, Artificial Sequence
  Description of Artificial Sequence: Synthetic oligonucleotide
aattcaaaaacactccaagaacatgactattctcgagaatagtcatgttcttggagtg

SEQ ID NO: 2740 - DNA, 58 bp, Artificial Sequence
  Description of Artificial Sequence: Synthetic oligonucleotide
aattcaaaaagtgaggtcgaaacaggataaactcgagtttatcctgtttcgacctcac

SEQ ID NO: 2741 - DNA, 58 bp, Artificial Sequence
  Description of Artificial Sequence: Synthetic oligonucleotide
aattcaaaaatttgtaggaagagggataatactcgagtattatccctcttcctacaaa

SEQ ID NO: 2742 - DNA, 58 bp, Artificial Sequence
  Description of Artificial Sequence: Synthetic oligonucleotide
aattcaaaaagccttgcattactgctgatatctcgagatatcagcagtaatgcaaggc

SEQ ID NO: 2743 - DNA, 58 bp, Artificial Sequence; identical to SEQ ID NO: 2742
  Description of Artificial Sequence: Synthetic oligonucleotide

SEQ ID NO: 2744 - DNA, 58 bp, Artificial Sequence
  Description of Artificial Sequence: Synthetic oligonucleotide
aattcaaaaagtcgtcagattccagtactatctcgagatagtactggaatctgacgac

SEQ ID NO: 2745 - DNA, 58 bp, Artificial Sequence; identical to SEQ ID NO: 2744
  Description of Artificial Sequence: Synthetic oligonucleotide

SEQ ID NO: 2746 - DNA, 58 bp, Artificial Sequence
  Description of Artificial Sequence: Synthetic oligonucleotide
aattcaaaaaccacgtctaccttcaccaatactcgagtattggtgaaggtagacgtgg

SEQ ID NO: 2747 - DNA, 58 bp, Artificial Sequence
  Description of Artificial Sequence: Synthetic oligonucleotide
aattcaaaaaacttcatctaacgagattaaactcgagtttaatctcgttagatgaagt

SEQ ID NO: 2748 - DNA, 58 bp, Artificial Sequence
  Description of Artificial Sequence: Synthetic oligonucleotide
aattcaaaaagcgacgagattaggctgttatctcgagataacagcctaatctcgtcgc

SEQ ID NO: 2749 - DNA, 58 bp, Artificial Sequence
  Description of Artificial Sequence: Synthetic oligonucleotide
aattcaaaaaacgagttggccctagacttagctcgagctaagtctagggccaactcgt

SEQ ID NO: 2750 - DNA, 58 bp, Artificial Sequence
  Description of Artificial Sequence: Synthetic oligonucleotide
aattcaaaaagcaggaatcgtgtgactaatactcgagtattagtcacacgattcctgc

SEQ ID NO: 2751 - DNA, 58 bp, Artificial Sequence; identical to SEQ ID NO: 2750
  Description of Artificial Sequence: Synthetic oligonucleotide

SEQ ID NO: 2752 - DNA, 58 bp, Artificial Sequence
  Description of Artificial Sequence: Synthetic oligonucleotide
aattcaaaaacctatttaatcctctcgtcaactcgagttgacgagaggattaaatagg

SEQ ID NO: 2753 - DNA, 58 bp, Artificial Sequence
  Description of Artificial Sequence: Synthetic oligonucleotide
aattcaaaaagccaatacatggaggttatatctcgagatataacctccatgtattggc

SEQ ID NO: 2754 - DNA, 58 bp, Artificial Sequence
  Description of Artificial Sequence: Synthetic oligonucleotide
aattcaaaaagccgcaagaacgaccactaatctcgagattagtggtcgttcttgcggc

SEQ ID NO: 2755 - DNA, 58 bp, Artificial Sequence
  Description of Artificial Sequence: Synthetic oligonucleotide
aattcaaaaacacattgtgaatcccatatttctcgagaaatatgggattcacaatgtg

SEQ ID NO: 2756 - DNA, 58 bp, Artificial Sequence
  Description of Artificial Sequence: Synthetic oligonucleotide
aattcaaaaaacaagttacctcacctaatttctcgagaaattaggtgaggtaacttgt

SEQ ID NO: 2757 - DNA, 58 bp, Artificial Sequence
  Description of Artificial Sequence: Synthetic oligonucleotide
aattcaaaaaagcccaatgtgtcattgtttactcgagtaaacaatgacacattgggct

SEQ ID NO: 2758 - DNA, 58 bp, Artificial Sequence
  Description of Artificial Sequence: Synthetic oligonucleotide
aattcaaaaatctctagtgagccctgaatttctcgagaaattcagggctcactagaga

SEQ ID NO: 2759 - DNA, 58 bp, Artificial Sequence
  Description of Artificial Sequence: Synthetic oligonucleotide
aattcaaaaaagttactccatcccaatttagctcgagctaaattgggatggagtaact

SEQ ID NO: 2760 - DNA, 58 bp, Artificial Sequence
  Description of Artificial Sequence: Synthetic oligonucleotide
aattcaaaaactaagcacttacgtgagtaaactcgagtttactcacgtaagtgcttag

SEQ ID NO: 2761 - DNA, 58 bp, Artificial Sequence
  Description of Artificial Sequence: Synthetic oligonucleotide
aattcaaaaataggcgcctggtgtatccattctcgagaatggatacaccaggcgccta

SEQ ID NO: 2762 - DNA, 58 bp, Artificial Sequence
  Description of Artificial Sequence: Synthetic oligonucleotide
aattcaaaaagcagtgccaatgccctctttactcgagtaaagagggcattggcactgc

SEQ ID NO: 2763 - DNA, 58 bp, Artificial Sequence
  Description of Artificial Sequence: Synthetic oligonucleotide
aattcaaaaaaccgcatagtcgtgtaccttgctcgagcaaggtacacgactatgcggt

SEQ ID NO: 2764 - DNA, 58 bp, Artificial Sequence
  Description of Artificial Sequence: Synthetic oligonucleotide
aattcaaaaacaacaacctggacaagctatgctcgagcatagcttgtccaggttgttg

SEQ ID NO: 2765 - DNA, 58 bp, Artificial Sequence
  Description of Artificial Sequence: Synthetic oligonucleotide
aattcaaaaatgacttgcgactacgtcattactcgagtaatgacgtagtcgcaagtca

SEQ ID NO: 2766 - DNA, 58 bp, Artificial Sequence
  Description of Artificial Sequence: Synthetic oligonucleotide
aattcaaaaaacttctgcagattcgatattactcgagtaatatcgaatctgcagaagt

SEQ ID NO: 2767 - DNA, 58 bp, Artificial Sequence
  Description of Artificial Sequence: Synthetic oligonucleotide
aattcaaaaagtaggctcagacataacatttctcgagaaatgttatgtctgagcctac

SEQ ID NO: 2768 - DNA, 58 bp, Artificial Sequence
  Description of Artificial Sequence: Synthetic oligonucleotide
aattcaaaaagccctagtactgtcttctttgctcgagcaaagaagacagtactagggc

SEQ ID NO: 2769 - DNA, 58 bp, Artificial Sequence
  Description of Artificial Sequence: Synthetic oligonucleotide
aattcaaaaagatcaagtcaccggagctttcctcgaggaaagctccggtgacttgatc

SEQ ID NO: 2770 - DNA, 58 bp, Artificial Sequence
  Description of Artificial Sequence: Synthetic oligonucleotide
aattcaaaaagctcccagaagatggtgtatcctcgaggatacaccatcttctgggagc

SEQ ID NO: 2771 - DNA, 58 bp, Artificial Sequence
  Description of Artificial Sequence: Synthetic oligonucleotide
aattcaaaaagcgagagggaagaccttctttctcgagaaagaaggtcttccctctcgc

SEQ ID NO: 2772 - DNA, 58 bp, Artificial Sequence
  Description of Artificial Sequence: Synthetic oligonucleotide
aattcaaaaacgagagggtgtacgtcaacatctcgagatgttgacgtacaccctctcg

SEQ ID NO: 2773 - DNA, 58 bp, Artificial Sequence
  Description of Artificial Sequence: Synthetic oligonucleotide
aattcaaaaagacgaaggaacaggcgtttctctcgagagaaacgcctgttccttcgtc

SEQ ID NO: 2774 - DNA, 58 bp, Artificial Sequence
  Description of Artificial Sequence: Synthetic oligonucleotide
aattcaaaaagatgacctgtgtcgatgtaaactcgagtttacatcgacacaggtcatc

SEQ ID NO: 2775 - DNA, 58 bp, Artificial Sequence
  Description of Artificial Sequence: Synthetic oligonucleotide
aattcaaaaaggtggaacagtgctgttatttctcgagaaataacagcactgttccacc

SEQ ID NO: 2776 - DNA, 58 bp, Artificial Sequence
  Description of Artificial Sequence: Synthetic oligonucleotide
aattcaaaaaccgttgaataccgccttgaatctcgagattcaaggcggtattcaacgg

SEQ ID NO: 2777 - DNA, 58 bp, Artificial Sequence
  Description of Artificial Sequence: Synthetic oligonucleotide
aattcaaaaagcatcctcaatggatgtgaaactcgagtttcacatccattgaggatgc

SEQ ID NO: 2778 - DNA, 58 bp, Artificial Sequence
  Description of Artificial Sequence: Synthetic oligonucleotide
aattcaaaaatgttgttcgggtcggagatttctcgagaaatctccgacccgaacaaca

SEQ ID NO: 2779 - DNA, 58 bp, Artificial Sequence
  Description of Artificial Sequence: Synthetic oligonucleotide
aattcaaaaaagcgcttcaaggtggtctttgctcgagcaaagaccaccttgaagcgct

SEQ ID NO: 2780 - DNA, 58 bp, Artificial Sequence
  Description of Artificial Sequence: Synthetic oligonucleotide
aattcaaaaagcttcgacatgccagactttgctcgagcaaagtctggcatgtcgaagc

SEQ ID NO: 2781 - DNA, 58 bp, Artificial Sequence
  Description of Artificial Sequence: Synthetic oligonucleotide
aattcaaaaatgaaacactacagggtgtatgctcgagcatacaccctgtagtgtttca

SEQ ID NO: 2782 - DNA, 58 bp, Artificial Sequence
  Description of Artificial Sequence: Synthetic oligonucleotide
aattcaaaaacaaccggctttgaaagagttactcgagtaactctttcaaagccggttg

SEQ ID NO: 2783 - DNA, 58 bp, Artificial Sequence
  Description of Artificial Sequence: Synthetic oligonucleotide
aattcaaaaatcagtgggatacgccacatttctcgagaaatgtggcgtatcccactga

SEQ ID NO: 2784 - DNA, 58 bp, Artificial Sequence
  Description of Artificial Sequence: Synthetic oligonucleotide
aattcaaaaatttatggtgtgtgcaagtaaactcgagtttacttgcacacaccataaa

SEQ ID NO: 2785 - DNA, 58 bp, Artificial Sequence
  Description of Artificial Sequence: Synthetic oligonucleotide
aattcaaaaagttagagaagaaggctattaactcgagttaatagccttcttctctaac

SEQ ID NO: 2786 - DNA, 58 bp, Artificial Sequence
  Description of Artificial Sequence: Synthetic oligonucleotide
aattcaaaaatgttaatgacttcgatctgatctcgagatcagatcgaagtcattaaca

SEQ ID NO: 2787 - DNA, 58 bp, Artificial Sequence
  Description of Artificial Sequence: Synthetic oligonucleotide
aattcaaaaactacatcaactattacgacatctcgagatgtcgtaatagttgatgtag

SEQ ID NO: 2788 - DNA, 58 bp, Artificial Sequence; identical to SEQ ID NO: 2787
  Description of Artificial Sequence: Synthetic oligonucleotide

SEQ ID NO: 2789 - DNA, 58 bp, Artificial Sequence
  Description of Artificial Sequence: Synthetic oligonucleotide
aattcaaaaagacagggtctacatcaactatctcgagatagttgatgtagaccctgtc

SEQ ID NO: 2790 - DNA, 58 bp, Artificial Sequence
  Description of Artificial Sequence: Synthetic oligonucleotide
aattcaaaaagccaagctgcacaatttaatactcgagtattaaattgtgcagcttggc

SEQ ID NO: 2791 - DNA, 58 bp, Artificial Sequence
  Description of Artificial Sequence: Synthetic oligonucleotide
aattcaaaaagctggcactgttcccagataactcgagttatctgggaacagtgccagc

SEQ ID NO: 2792 - DNA, 58 bp, Artificial Sequence
  Description of Artificial Sequence: Synthetic oligonucleotide
aattcaaaaaagaaagaccactggcagaaacctcgaggtttctgccagtggtctttct

SEQ ID NO: 2793 - DNA, 58 bp, Artificial Sequence
  Description of Artificial Sequence: Synthetic oligonucleotide
aattcaaaaaaggcccaactatggatatattctcgagaatatatccatagttgggcct

SEQ ID NO: 2794 - DNA, 58 bp, Artificial Sequence
  Description of Artificial Sequence: Synthetic oligonucleotide
aattcaaaaagagctagaaggagatcaaattctcgagaatttgatctccttctagctc

SEQ ID NO: 2795 - DNA, 58 bp, Artificial Sequence
  Description of Artificial Sequence: Synthetic oligonucleotide
aattcaaaaagtatgctttaaagtctatttcctcgaggaaatagactttaaagcatac

SEQ ID NO: 2796 - DNA, 58 bp, Artificial Sequence
  Description of Artificial Sequence: Synthetic oligonucleotide
aattcaaaaaagcgatagctatgacatttatctcgagataaatgtcatagctatcgct

SEQ ID NO: 2797 - DNA, 58 bp, Artificial Sequence
  Description of Artificial Sequence: Synthetic oligonucleotide
aattcaaaaagtgaagatctaagacatttaactcgagttaaatgtcttagatcttcac

SEQ ID NO: 2798 - DNA, 58 bp, Artificial Sequence
  Description of Artificial Sequence: Synthetic oligonucleotide
aattcaaaaatacaaggttactcactataaactcgagtttatagtgagtaaccttgta

SEQ ID NO: 2799 - DNA, 58 bp, Artificial Sequence; identical to SEQ ID NO: 2790
  Description of Artificial Sequence: Synthetic oligonucleotide

SEQ ID NO: 2800 - DNA, 58 bp, Artificial Sequence; identical to SEQ ID NO: 2791
  Description of Artificial Sequence: Synthetic oligonucleotide

SEQ ID NO: 2801 - DNA, 58 bp, Artificial Sequence; identical to SEQ ID NO: 2792
  Description of Artificial Sequence: Synthetic oligonucleotide

SEQ ID NO: 2802 - DNA, 58 bp, Artificial Sequence
  Description of Artificial Sequence: Synthetic oligonucleotide
aattcaaaaactgctaaaggttaccgatttcctcgaggaaatcggtaacctttagcag

SEQ ID NO: 2803 - DNA, 58 bp, Artificial Sequence
  Description of Artificial Sequence: Synthetic oligonucleotide
aattcaaaaactctgcatattctagtaataactcgagttattactagaatatgcagag

SEQ ID NO: 2804 - DNA, 58 bp, Artificial Sequence
  Description of Artificial Sequence: Synthetic oligonucleotide
aattcaaaaaacggacagctcattcataatgctcgagcattatgaatgagctgtccgt

SEQ ID NO: 2805 - DNA, 58 bp, Artificial Sequence
  Description of Artificial Sequence: Synthetic oligonucleotide
aattcaaaaaccgttcaaggaaatttctattctcgagaatagaaatttccttgaacgg

SEQ ID NO: 2806 - DNA, 58 bp, Artificial Sequence
  Description of Artificial Sequence: Synthetic oligonucleotide
aattcaaaaacgggtctctaagatgtcttatctcgagataagacatcttagagacccg

SEQ ID NO: 2807 - DNA, 58 bp, Artificial Sequence
  Description of Artificial Sequence: Synthetic oligonucleotide
aattcaaaaaacctgctcagaaatcataaatctcgagatttatgatttctgagcaggt

SEQ ID NO: 2808 - DNA, 58 bp, Artificial Sequence
  Description of Artificial Sequence: Synthetic oligonucleotide
aattcaaaaagtgctcctagatcaccataaactcgagtttatggtgatctaggagcac

SEQ ID NO: 2809 - DNA, 58 bp, Artificial Sequence
  Description of Artificial Sequence: Synthetic oligonucleotide
aattcaaaaacacctatagctttcatgtattctcgagaatacatgaaagctataggtg

SEQ ID NO: 2810 - DNA, 58 bp, Artificial Sequence
  Description of Artificial Sequence: Synthetic oligonucleotide
aattcaaaaagcatgctgtatgtggataatgctcgagcattatccacatacagcatgc

SEQ ID NO: 2811 - DNA, 58 bp, Artificial Sequence
  Description of Artificial Sequence: Synthetic oligonucleotide
aattcaaaaaaggtcagtattatacgttaaactcgagtttaacgtataatactgacct

SEQ ID NO: 2812 - DNA, 58 bp, Artificial Sequence
  Description of Artificial Sequence: Synthetic oligonucleotide
aattcaaaaaattctggttgttgctaataatctcgagattattagcaacaaccagaat

SEQ ID NO: 2813 - DNA, 58 bp, Artificial Sequence
  Description of Artificial Sequence: Synthetic oligonucleotide
aattcaaaaatgcggaggaagttacagatgtctcgagacatctgtaacttcctccgca

SEQ ID NO: 2814 - DNA, 58 bp, Artificial Sequence
  Description of Artificial Sequence: Synthetic oligonucleotide
aattcaaaaagatatcacagaggcctataacctcgaggttataggcctctgtgatatc

SEQ ID NO: 2815 - DNA, 58 bp, Artificial Sequence
  Description of Artificial Sequence: Synthetic oligonucleotide
aattcaaaaaggctgattctggagagtatatctcgagatatactctccagaatcagcc

SEQ ID NO: 2816 - DNA, 58 bp, Artificial Sequence
  Description of Artificial Sequence: Synthetic oligonucleotide
aattcaaaaagacagtgcctctgccaatatcctcgaggatattggcagaggcactgtc

SEQ ID NO: 2817 - DNA, 58 bp, Artificial Sequence
  Description of Artificial Sequence: Synthetic oligonucleotide
aattcaaaaatatactagaatcaccgcatttctcgagaaatgcggtgattctagtata

SEQ ID NO: 2818 - DNA, 58 bp, Artificial Sequence
  Description of Artificial Sequence: Synthetic oligonucleotide
aattcaaaaacagccttgaatgcacttatatctcgagatataagtgcattcaaggctg

SEQ ID NO: 2819 - DNA, 58 bp, Artificial Sequence; identical to SEQ ID NO: 2818
  Description of Artificial Sequence: Synthetic oligonucleotide

SEQ ID NO: 2820 - DNA, 58 bp, Artificial Sequence
  Description of Artificial Sequence: Synthetic oligonucleotide
aattcaaaaacgactgcaagtatgactttatctcgagataaagtcatacttgcagtcg

SEQ ID NO: 2821 - DNA, 58 bp, Artificial Sequence
  Description of Artificial Sequence: Synthetic oligonucleotide
aattcaaaaaccggattgctaatgaacagatctcgagatctgttcattagcaatccgg

SEQ ID NO: 2822 - DNA, 58 bp, Artificial Sequence
  Description of Artificial Sequence: Synthetic oligonucleotide
aattcaaaaacctcaacttcaaccctcacttctcgagaagtgagggttgaagttgagg

SEQ ID NO: 2823 - DNA, 58 bp, Artificial Sequence
  Description of Artificial Sequence: Synthetic oligonucleotide
aattcaaaaaacttcctcctttccgtgtttcctcgaggaaacacggaaaggaggaagt

SEQ ID NO: 2824 - DNA, 58 bp, Artificial Sequence
  Description of Artificial Sequence: Synthetic oligonucleotide
aattcaaaaaggaccgactttccattgattcctcgaggaatcaatggaaagtcggtcc

SEQ ID NO: 2825 - DNA, 58 bp, Artificial Sequence
  Description of Artificial Sequence: Synthetic oligonucleotide
aattcaaaaatggtccttgcactcctgtttcctcgaggaaacaggagtgcaaggacca

SEQ ID NO: 2826 - DNA, 58 bp, Artificial Sequence
  Description of Artificial Sequence: Synthetic oligonucleotide
aattcaaaaataacctgactcatcgagtttactcgagtaaactcgatgagtcaggtta

SEQ ID NO: 2827 - DNA, 58 bp, Artificial Sequence
  Description of Artificial Sequence: Synthetic oligonucleotide
aattcaaaaaaggagaaccctcacctaataactcgagttattaggtgagggttctcct

SEQ ID NO: 2828 - DNA, 58 bp, Artificial Sequence
  Description of Artificial Sequence: Synthetic oligonucleotide
aattcaaaaagcactccataaggaataatttctcgagaaattattccttatggagtgc

SEQ ID NO: 2829 - DNA, 58 bp, Artificial Sequence
  Description of Artificial Sequence: Synthetic oligonucleotide
aattcaaaaagtagccgtgatgtggtcatttctcgagaaatgaccacatcacggctac

SEQ ID NO: 2830 - DNA, 58 bp, Artificial Sequence
  Description of Artificial Sequence: Synthetic oligonucleotide
aattcaaaaagcaattgttgaagccctgaatctcgagattcagggcttcaacaattgc

SEQ ID NO: 2831 - DNA, 58 bp, Artificial Sequence
  Description of Artificial Sequence: Synthetic oligonucleotide
aattcaaaaaactctgagaatcgtgtggaaactcgagtttccacacgattctcagagt

SEQ ID NO: 2832 - DNA, 58 bp, Artificial Sequence
  Description of Artificial Sequence: Synthetic oligonucleotide
aattcaaaaagcctctggtatgagaaataaactcgagtttatttctcataccagaggc

SEQ ID NO: 2833 - DNA, 58 bp, Artificial Sequence
  Description of Artificial Sequence: Synthetic oligonucleotide
aattcaaaaaagtccacgcgcaagaacaaagctcgagctttgttcttgcgcgtggact

SEQ ID NO: 2834 - DNA, 58 bp, Artificial Sequence
  Description of Artificial Sequence: Synthetic oligonucleotide
aattcaaaaatgaccctggttggaatcatagctcgagctatgattccaaccagggtca

SEQ ID NO: 2835 - DNA, 58 bp, Artificial Sequence
  Description of Artificial Sequence: Synthetic oligonucleotide
aattcaaaaaacgctgaagaatggaaggaaactcgagtttccttccattcttcagcgt

SEQ ID NO: 2836 - DNA, 58 bp, Artificial Sequence
  Description of Artificial Sequence: Synthetic oligonucleotide
aattcaaaaaccaactgatagccacgctgaactcgagttcagcgtggctatcagttgg

SEQ ID NO: 2837 - DNA, 58 bp, Artificial Sequence
  Description of Artificial Sequence: Synthetic oligonucleotide
aattcaaaaacacgctgaagaatggaaggaactcgagttccttccattcttcagcgtg

SEQ ID NO: 2838 - DNA, 58 bp, Artificial Sequence
  Description of Artificial Sequence: Synthetic oligonucleotide
aattcaaaaagttgtggtatagtcaatctatctcgagatagattgactataccacaac

SEQ ID NO: 2839 - DNA, 58 bp, Artificial Sequence
  Description of Artificial Sequence: Synthetic oligonucleotide
aattcaaaaaagctgcctaagtgtgcactttctcgagaaagtgcacacttaggcagct

SEQ ID NO: 2840 - DNA, 58 bp, Artificial Sequence
  Description of Artificial Sequence: Synthetic oligonucleotide
aattcaaaaactgacacatcacaatttcatactcgagtatgaaattgtgatgtgtcag

SEQ ID NO: 2841 - DNA, 58 bp, Artificial Sequence
  Description of Artificial Sequence: Synthetic oligonucleotide
aattcaaaaagtgcccactcaggtcacttatctcgagataagtgacctgagtgggcac

SEQ ID NO: 2842 - DNA, 58 bp, Artificial Sequence
  Description of Artificial Sequence: Synthetic oligonucleotide
aattcaaaaacttacgctatgtggtggtatcctcgaggataccaccacatagcgtaag

SEQ ID NO: 2843 - DNA, 58 bp, Artificial Sequence
  Description of Artificial Sequence: Synthetic oligonucleotide
aattcaaaaacatcagcttcatgggcaactactcgagtagttgcccatgaagctgatg

SEQ ID NO: 2844 - DNA, 58 bp, Artificial Sequence
  Description of Artificial Sequence: Synthetic oligonucleotide
aattcaaaaacctgtcggtgattgagatgatctcgagatcatctcaatcaccgacagg

SEQ ID NO: 2845 - DNA, 58 bp, Artificial Sequence; identical to SEQ ID NO: 2844
  Description of Artificial Sequence: Synthetic oligonucleotide

SEQ ID NO: 2846 - DNA, 58 bp, Artificial Sequence
  Description of Artificial Sequence: Synthetic oligonucleotide
aattcaaaaacgaaagggaatcctcctgtttctcgagaaacaggaggattccctttcg

SEQ ID NO: 2847 - DNA, 58 bp, Artificial Sequence
  Description of Artificial Sequence: Synthetic oligonucleotide
aattcaaaaaaggtgatgaatctgctgattactcgagtaatcagcagattcatcacct

SEQ ID NO: 2848 - DNA, 58 bp, Artificial Sequence
  Description of Artificial Sequence: Synthetic oligonucleotide
aattcaaaaatgtttctgccaaacttctttactcgagtaaagaagtttggcagaaaca

SEQ ID NO: 2849 - DNA, 58 bp, Artificial Sequence
  Description of Artificial Sequence: Synthetic oligonucleotide
aattcaaaaactcccaggaagggtagaatttctcgagaaattctacccttcctgggag

SEQ ID NO: 2850 - DNA, 58 bp, Artificial Sequence
  Description of Artificial Sequence: Synthetic oligonucleotide
aattcaaaaaagattgcgactggactcaaacctcgaggtttgagtccagtcgcaatct

SEQ ID NO: 2851 - DNA, 58 bp, Artificial Sequence
  Description of Artificial Sequence: Synthetic oligonucleotide
aattcaaaaagttcctgacgtcagtcgaaatctcgagatttcgactgacgtcaggaac

SEQ ID NO: 2852 - DNA, 58 bp, Artificial Sequence
  Description of Artificial Sequence: Synthetic oligonucleotide
aattcaaaaagaaggattcttgaccatcaatctcgagattgatggtcaagaatccttc

SEQ ID NO: 2853 - DNA, 58 bp, Artificial Sequence
  Description of Artificial Sequence: Synthetic oligonucleotide
aattcaaaaacacctcacaaattgaagtgatctcgagatcacttcaatttgtgaggtg

SEQ ID NO: 2854 - DNA, 58 bp, Artificial Sequence
  Description of Artificial Sequence: Synthetic oligonucleotide
aattcaaaaagccctcatattccaacaacttctcgagaagttgttggaatatgagggc

SEQ ID NO: 2855 - DNA, 58 bp, Artificial Sequence
  Description of Artificial Sequence: Synthetic oligonucleotide
aattcaaaaagcttctcaaagcaggagcaatctcgagattgctcctgctttgagaagc

SEQ ID NO: 2856 - DNA, 58 bp, Artificial Sequence
  Description of Artificial Sequence: Synthetic oligonucleotide
aattcaaaaacgaggatgagattgccctctactcgagtagagggcaatctcatcctcg

SEQ ID NO: 2857 - DNA, 58 bp, Artificial Sequence
  Description of Artificial Sequence: Synthetic oligonucleotide
aattcaaaaaacgacaaggatcaagaattagctcgagctaattcttgatccttgtcgt

SEQ ID NO: 2858 - DNA, 58 bp, Artificial Sequence
  Description of Artificial Sequence: Synthetic oligonucleotide
aattcaaaaacctgtctcttatccctttaatctcgagattaaagggataagagacagg

SEQ ID NO: 2859 - DNA, 58 bp, Artificial Sequence
  Description of Artificial Sequence: Synthetic oligonucleotide
aattcaaaaagaaagcagcccagattataatctcgagattataatctgggctgctttc

SEQ ID NO: 2860 - DNA, 58 bp, Artificial Sequence
  Description of Artificial Sequence: Synthetic oligonucleotide
aattcaaaaatcatagagggctcccagaagtctcgagacttctgggagccctctatga

SEQ ID NO: 2861 - DNA, 58 bp, Artificial Sequence
  Description of Artificial Sequence: Synthetic oligonucleotide
aattcaaaaacccgtgaaccacctcatagagctcgagctctatgaggtggttcacggg

SEQ ID NO: 2862 - DNA, 58 bp, Artificial Sequence
  Description of Artificial Sequence: Synthetic oligonucleotide
aattcaaaaagactggagcatctacacctgactcgagtcaggtgtagatgctccagtc

SEQ ID NO: 2863 - DNA, 58 bp, Artificial Sequence
  Description of Artificial Sequence: Synthetic oligonucleotide
aattcaaaaacaccagagaaataacagacaactcgagttgtctgttatttctctggtg

SEQ ID NO: 2864 - DNA, 58 bp, Artificial Sequence
  Description of Artificial Sequence: Synthetic oligonucleotide
aattcaaaaaccatgactcgaatatctgaaactcgagtttcagatattcgagtcatgg

SEQ ID NO: 2865 - DNA, 58 bp, Artificial Sequence; identical to SEQ ID NO: 2864
  Description of Artificial Sequence: Synthetic oligonucleotide

SEQ ID NO: 2866 - DNA, 58 bp, Artificial Sequence
  Description of Artificial Sequence: Synthetic oligonucleotide
aattcaaaaagtgcttcctgcaggaccattactcgagtaatggtcctgcaggaagcac

SEQ ID NO: 2867 - DNA, 58 bp, Artificial Sequence
  Description of Artificial Sequence: Synthetic oligonucleotide
aattcaaaaaagacctctgcaactcggaactctcgagagttccgagttgcagaggtct

SEQ ID NO: 2868 - DNA, 58 bp, Artificial Sequence
  Description of Artificial Sequence: Synthetic oligonucleotide
aattcaaaaactcaagtgctacacctgcaagctcgagcttgcaggtgtagcacttgag

SEQ ID NO: 2869 - DNA, 58 bp, Artificial Sequence
  Description of Artificial Sequence: Synthetic oligonucleotide
aattcaaaaagatgccacagaaatcctttatctcgagataaaggatttctgtggcatc

SEQ ID NO: 2870 - DNA, 58 bp, Artificial Sequence
  Description of Artificial Sequence: Synthetic oligonucleotide
aattcaaaaaggaactgcgttccaccaaatactcgagtatttggtggaacgcagttcc

SEQ ID NO: 2871 - DNA, 58 bp, Artificial Sequence
  Description of Artificial Sequence: Synthetic oligonucleotide
aattcaaaaatgaatcttcacagtaacatttctcgagaaatgttactgtgaagattca

SEQ ID NO: 2872 - DNA, 58 bp, Artificial Sequence
  Description of Artificial Sequence: Synthetic oligonucleotide
aattcaaaaagaagtgagcctgtgatcaatactcgagtattgatcacaggctcacttc

SEQ ID NO: 2873 - DNA, 58 bp, Artificial Sequence
  Description of Artificial Sequence: Synthetic oligonucleotide
aattcaaaaatatacgctgcggtggatatacctcgaggtatatccaccgcagcgtata

SEQ ID NO: 2874 - DNA, 58 bp, Artificial Sequence
  Description of Artificial Sequence: Synthetic oligonucleotide
aattcaaaaatcgtgatctcatcacaaataactcgagttatttgtgatgagatcacga

SEQ ID NO: 2875 - DNA, 58 bp, Artificial Sequence
  Description of Artificial Sequence: Synthetic oligonucleotide
aattcaaaaagccctatgacacggatctatactcgagtatagatccgtgtcatagggc

SEQ ID NO: 2876 - DNA, 58 bp, Artificial Sequence
  Description of Artificial Sequence: Synthetic oligonucleotide
aattcaaaaaagagcttcgccgagaacaactctcgagagttgttctcggcgaagctct

SEQ ID NO: 2877 - DNA, 58 bp, Artificial Sequence
  Description of Artificial Sequence: Synthetic oligonucleotide
aattcaaaaacggatctataccaacgccaaactcgagtttggcgttggtatagatccg

SEQ ID NO: 2878 - DNA, 58 bp, Artificial Sequence
  Description of Artificial Sequence: Synthetic oligonucleotide
aattcaaaaaccgtatgtaaatcagatctccctcgagggagatctgatttacatacgg

SEQ ID NO: 2879 - DNA, 58 bp, Artificial Sequence
  Description of Artificial Sequence: Synthetic oligonucleotide
aattcaaaaaccacaagcagtccagattatactcgagtataatctggactgcttgtgg

SEQ ID NO: 2880 - DNA, 58 bp, Artificial Sequence
  Description of Artificial Sequence: Synthetic oligonucleotide
aattcaaaaaccgaggtgatagtgtggtttactcgagtaaaccacactatcacctcgg

SEQ ID NO: 2881 - DNA, 58 bp, Artificial Sequence
  Description of Artificial Sequence: Synthetic oligonucleotide
aattcaaaaacttcagggttatgtctatgttctcgagaacatagacataaccctgaag

SEQ ID NO: 2882 - DNA, 58 bp, Artificial Sequence
  Description of Artificial Sequence: Synthetic oligonucleotide
aattcaaaaagccctaactacagtcgtttacctcgaggtaaacgactgtagttagggc

SEQ ID NO: 2883 - DNA, 58 bp, Artificial Sequence
  Description of Artificial Sequence: Synthetic oligonucleotide
aattcaaaaacctgttgtggtccaagtttaactcgagttaaacttggaccacaacagg

SEQ ID NO: 2884 - DNA, 58 bp, Artificial Sequence
  Description of Artificial Sequence: Synthetic oligonucleotide
aattcaaaaacgcttccaacacgcatatcttctcgagaagatatgcgtgttggaagcg

SEQ ID NO: 2885 - DNA, 58 bp, Artificial Sequence
  Description of Artificial Sequence: Synthetic oligonucleotide
aattcaaaaaacaatgtgacccagatgattgctcgagcaatcatctgggtcacattgt

SEQ ID NO: 2886 - DNA, 58 bp, Artificial Sequence
  Description of Artificial Sequence: Synthetic oligonucleotide
aattcaaaaactttgtagtttgcccagagttctcgagaactctgggcaaactacaaag

SEQ ID NO: 2887 - DNA, 58 bp, Artificial Sequence
  Description of Artificial Sequence: Synthetic oligonucleotide
aattcaaaaaggccatggctgctttgtagttctcgagaactacaaagcagccatggcc

SEQ ID NO: 2888 - DNA, 58 bp, Artificial Sequence
  Description of Artificial Sequence: Synthetic oligonucleotide
aattcaaaaaggtggctgagatcacaaagcactcgagtgctttgtgatctcagccacc

SEQ ID NO: 2889 - DNA, 58 bp, Artificial Sequence
  Description of Artificial Sequence: Synthetic oligonucleotide
aattcaaaaaactgcggatctctgtgtcattctcgagaatgacacagagatccgcagt

SEQ ID NO: 2890 - DNA, 58 bp, Artificial Sequence
  Description of Artificial Sequence: Synthetic oligonucleotide
aattcaaaaaccacaacgaaatctatgacaactcgagttgtcatagatttcgttgtgg

SEQ ID NO: 2891 - DNA, 58 bp, Artificial Sequence; identical to SEQ ID NO: 2890
  Description of Artificial Sequence: Synthetic oligonucleotide

SEQ ID NO: 2892 - DNA, 58 bp, Artificial Sequence
  Description of Artificial Sequence: Synthetic oligonucleotide
aattcaaaaagcggcctattgctttagaaatctcgagatttctaaagcaataggccgc

SEQ ID NO: 2893 - DNA, 58 bp, Artificial Sequence
  Description of Artificial Sequence: Synthetic oligonucleotide
aattcaaaaagctggagcatgcccgtatttactcgagtaaatacgggcatgctccagc

SEQ ID NO: 2894 - DNA, 58 bp, Artificial Sequence
  Description of Artificial Sequence: Synthetic oligonucleotide
aattcaaaaattgctgcctacgtccactttactcgagtaaagtggacgtaggcagcaa

SEQ ID NO: 2895 - DNA, 58 bp, Artificial Sequence
  Description of Artificial Sequence: Synthetic oligonucleotide
aattcaaaaacattgccaaacagcgctatatctcgagatatagcgctgtttggcaatg

SEQ ID NO: 2896 - DNA, 58 bp, Artificial Sequence
  Description of Artificial Sequence: Synthetic oligonucleotide
aattcaaaaagctctagggaatctggattatctcgagataatccagattccctagagc

SEQ ID NO: 2897 - DNA, 58 bp, Artificial Sequence
  Description of Artificial Sequence: Synthetic oligonucleotide
aattcaaaaacggaatactatgccaaagaaactcgagtttctttggcatagtattccg

SEQ ID NO: 2898 - DNA, 58 bp, Artificial Sequence
  Description of Artificial Sequence: Synthetic oligonucleotide
aattcaaaaagccttgagagtaatggctaaactcgagtttagccattactctcaaggc

SEQ ID NO: 2899 - DNA, 58 bp, Artificial Sequence
  Description of Artificial Sequence: Synthetic oligonucleotide
aattcaaaaactcatgttgatggtctatatcctcgaggatatagaccatcaacatgag

SEQ ID NO: 2900 - DNA, 58 bp, Artificial Sequence
  Description of Artificial Sequence: Synthetic oligonucleotide
aattcaaaaagaagttgctgttaagatattcctcgaggaatatcttaacagcaacttc

SEQ ID NO: 2901 - DNA, 58 bp, Artificial Sequence
  Description of Artificial Sequence: Synthetic oligonucleotide
aattcaaaaacgttcagaagtcggttaataactcgagttattaaccgacttctgaacg

SEQ ID NO: 2902 - DNA, 58 bp, Artificial Sequence
  Description of Artificial Sequence: Synthetic oligonucleotide
aattcaaaaactctaggctttatcgtgtttactcgagtaaacacgataaagcctagag

SEQ ID NO: 2903 - DNA, 58 bp, Artificial Sequence
  Description of Artificial Sequence: Synthetic oligonucleotide
aattcaaaaactcaggaaatgagattgatttctcgagaaatcaatctcatttcctgag

SEQ ID NO: 2904 - DNA, 58 bp, Artificial Sequence
  Description of Artificial Sequence: Synthetic oligonucleotide
aattcaaaaaggagttggtaaagggttaatactcgagtattaaccctttaccaactcc

SEQ ID NO: 2905 - DNA, 58 bp, Artificial Sequence
  Description of Artificial Sequence: Synthetic oligonucleotide
aattcaaaaataatggatttccgggagatatctcgagatatctcccggaaatccatta

SEQ ID NO: 2906 - DNA, 58 bp, Artificial Sequence
  Description of Artificial Sequence: Synthetic oligonucleotide
aattcaaaaacacacccagggctagtataaactcgagtttatactagccctgggtgtg

SEQ ID NO: 2907 - DNA, 58 bp, Artificial Sequence
  Description of Artificial Sequence: Synthetic oligonucleotide
aattcaaaaagtaggttatgatgagtttaatctcgagattaaactcatcataacctac

SEQ ID NO: 2908 - DNA, 58 bp, Artificial Sequence
  Description of Artificial Sequence: Synthetic oligonucleotide
aattcaaaaacgtgactgtaagattgtaaatctcgagatttacaatcttacagtcacg

SEQ ID NO: 2909 - DNA, 58 bp, Artificial Sequence
  Description of Artificial Sequence: Synthetic oligonucleotide
aattcaaaaagagatccctaatcatcaaattctcgagaatttgatgattagggatctc

SEQ ID NO: 2910 - DNA, 58 bp, Artificial Sequence
  Description of Artificial Sequence: Synthetic oligonucleotide
aattcaaaaagagccgatcaagactgtgtttctcgagaaacacagtcttgatcggctc

SEQ ID NO: 2911 - DNA, 58 bp, Artificial Sequence
  Description of Artificial Sequence: Synthetic oligonucleotide
aattcaaaaagctgccattgagagtgttcaactcgagttgaacactctcaatggcagc

SEQ ID NO: 2912 - DNA, 58 bp, Artificial Sequence; identical to SEQ ID NO: 2911
  Description of Artificial Sequence: Synthetic oligonucleotide

SEQ ID NO: 2913 - DNA, 58 bp, Artificial Sequence
  Description of Artificial Sequence: Synthetic oligonucleotide
aattcaaaaagacctccgagtcctcagtaaactcgagtttactgaggactcggaggtc

SEQ ID NO: 2914 - DNA, 58 bp, Artificial Sequence
  Description of Artificial Sequence: Synthetic oligonucleotide
aattcaaaaaagctagctctttggtctatttctcgagaaatagaccaaagagctagct

SEQ ID NO: 2915 - DNA, 58 bp, Artificial Sequence
  Description of Artificial Sequence: Synthetic oligonucleotide
aattcaaaaacaacctccagcctggatattcctcgaggaatatccaggctggaggttg

SEQ ID NO: 2916 - DNA, 58 bp, Artificial Sequence
  Description of Artificial Sequence: Synthetic oligonucleotide
aattcaaaaagcacagtgtttccctgtttatctcgagataaacagggaaacactgtgc

SEQ ID NO: 2917 - DNA, 58 bp, Artificial Sequence; identical to SEQ ID NO: 2916
  Description of Artificial Sequence: Synthetic oligonucleotide

SEQ ID NO: 2918 - DNA, 58 bp, Artificial Sequence
  Description of Artificial Sequence: Synthetic oligonucleotide
aattcaaaaaacagacggccttctgcaattcctcgaggaattgcagaaggccgtctgt

SEQ ID NO: 2919 - DNA, 58 bp, Artificial Sequence
  Description of Artificial Sequence: Synthetic oligonucleotide
aattcaaaaagaacccaagcttagaactttactcgagtaaagttctaagcttgggttc

SEQ ID NO: 2920 - DNA, 58 bp, Artificial Sequence
  Description of Artificial Sequence: Synthetic oligonucleotide
aattcaaaaaggagccagctccctctatttactcgagtaaatagagggagctggctcc

SEQ ID NO: 2921 - DNA, 58 bp, Artificial Sequence
  Description of Artificial Sequence: Synthetic oligonucleotide
aattcaaaaatggcgtggagctgagagataactcgagttatctctcagctccacgcca

SEQ ID NO: 2922 - DNA, 58 bp, Artificial Sequence
  Description of Artificial Sequence: Synthetic oligonucleotide
aattcaaaaagcacgtggtgtaacctcagaactcgagttctgaggttacaccacgtgc

SEQ ID NO: 2923 - DNA, 58 bp, Artificial Sequence
  Description of Artificial Sequence: Synthetic oligonucleotide
aattcaaaaacagcaatagctcggacgcaatctcgagattgcgtccgagctattgctg

SEQ ID NO: 2924 - DNA, 58 bp, Artificial Sequence
  Description of Artificial Sequence: Synthetic oligonucleotide
aattcaaaaagacagctacaagcctggagttctcgagaactccaggcttgtagctgtc

SEQ ID NO: 2925 - DNA, 58 bp, Artificial Sequence
  Description of Artificial Sequence: Synthetic oligonucleotide
aattcaaaaagcttctacaacgacgtggtcactcgagtgaccacgtcgttgtagaagc

SEQ ID NO: 2926 - DNA, 58 bp, Artificial Sequence
  Description of Artificial Sequence: Synthetic oligonucleotide
aattcaaaaatgtttacttgcccggtttaatctcgagattaaaccgggcaagtaaaca

SEQ ID NO: 2927 - DNA, 58 bp, Artificial Sequence
  Description of Artificial Sequence: Synthetic oligonucleotide
aattcaaaaatgtaccagtgagaagcattatctcgagataatgcttctcactggtaca

SEQ ID NO: 2928 - DNA, 58 bp, Artificial Sequence
  Description of Artificial Sequence: Synthetic oligonucleotide
aattcaaaaatgggacggtgctgtaacaaatctcgagatttgttacagcaccgtccca

SEQ ID NO: 2929 - DNA, 58 bp, Artificial Sequence
  Description of Artificial Sequence: Synthetic oligonucleotide
aattcaaaaagaaagcactcacagctaatttctcgagaaattagctgtgagtgctttc

SEQ ID NO: 2930 - DNA, 58 bp, Artificial Sequence
  Description of Artificial Sequence: Synthetic oligonucleotide
aattcaaaaagataaatgcttgctgcataaactcgagtttatgcagcaagcatttatc

SEQ ID NO: 2931 - DNA, 58 bp, Artificial Sequence
  Description of Artificial Sequence: Synthetic oligonucleotide
aattcaaaaaccagtgtgtgttcattgtaaactcgagtttacaatgaacacacactgg

SEQ ID NO: 2932 - DNA, 58 bp, Artificial Sequence
  Description of Artificial Sequence: Synthetic oligonucleotide
aattcaaaaaagaaccagtaccggcattattctcgagaataatgccggtactggttct

SEQ ID NO: 2933 - DNA, 58 bp, Artificial Sequence
  Description of Artificial Sequence: Synthetic oligonucleotide
aattcaaaaaggagctgttggtgggaatatactcgagtatattcccaccaacagctcc

SEQ ID NO: 2934 - DNA, 58 bp, Artificial Sequence
  Description of Artificial Sequence: Synthetic oligonucleotide
aattcaaaaacttgaaggaactactactaagctcgagcttagtagtagttccttcaag

SEQ ID NO: 2935 - DNA, 58 bp, Artificial Sequence
  Description of Artificial Sequence: Synthetic oligonucleotide
aattcaaaaagctccgtttctctgttgttaactcgagttaacaacagagaaacggagc

SEQ ID NO: 2936 - DNA, 58 bp, Artificial Sequence
  Description of Artificial Sequence: Synthetic oligonucleotide
aattcaaaaacaagaacaccatcctacataactcgagttatgtaggatggtgttcttg

SEQ ID NO: 2937 - DNA, 58 bp, Artificial Sequence
  Description of Artificial Sequence: Synthetic oligonucleotide
aattcaaaaacagtccctgtcctccaaatagctcgagctatttggaggacagggactg

SEQ ID NO: 2938 - DNA, 58 bp, Artificial Sequence
  Description of Artificial Sequence: Synthetic oligonucleotide
aattcaaaaacaagttggaccttgatatttactcgagtaaatatcaaggtccaacttg

SEQ ID NO: 2939 - DNA, 58 bp, Artificial Sequence
  Description of Artificial Sequence: Synthetic oligonucleotide
aattcaaaaactactatgtcttctttcaactctcgagagttgaaagaagacatagtag

SEQ ID NO: 2940 - DNA, 58 bp, Artificial Sequence
  Description of Artificial Sequence: Synthetic oligonucleotide
aattcaaaaacccttcaccgaggtcggaatactcgagtattccgacctcggtgaaggg

SEQ ID NO: 2941 - DNA, 58 bp, Artificial Sequence
  Description of Artificial Sequence: Synthetic oligonucleotide
aattcaaaaatgagctacaaagaggacacgactcgagtcgtgtcctctttgtagctca

SEQ ID NO: 2942 - DNA, 58 bp, Artificial Sequence
  Description of Artificial Sequence: Synthetic oligonucleotide
aattcaaaaaagaaatagttgttggtctaaactcgagtttagaccaacaactatttct

SEQ ID NO: 2943 - DNA, 58 bp, Artificial Sequence
  Description of Artificial Sequence: Synthetic oligonucleotide
aattcaaaaaagttatcctgaccctatattgctcgagcaatatagggtcaggataact

SEQ ID NO: 2944 - DNA, 58 bp, Artificial Sequence
  Description of Artificial Sequence: Synthetic oligonucleotide
aattcaaaaagacaaacaaatggtccaatatctcgagatattggaccatttgtttgtc

SEQ ID NO: 2945 - DNA, 58 bp, Artificial Sequence
  Description of Artificial Sequence: Synthetic oligonucleotide
aattcaaaaactaatggtgtacgtcactaaactcgagtttagtgacgtacaccattag

SEQ ID NO: 2946 - DNA, 58 bp, Artificial Sequence
  Description of Artificial Sequence: Synthetic oligonucleotide
aattcaaaaaccggatcaggatgcaacatacctcgaggtatgttgcatcctgatccgg

SEQ ID NO: 2947 - DNA, 58 bp, Artificial Sequence
  Description of Artificial Sequence: Synthetic oligonucleotide
aattcaaaaagcagtatatttcttcgttcttctcgagaagaacgaagaaatatactgc

SEQ ID NO: 2948 - DNA, 58 bp, Artificial Sequence
  Description of Artificial Sequence: Synthetic oligonucleotide
aattcaaaaagtattcccactcttatcttacctcgaggtaagataagagtgggaatac

SEQ ID NO: 2949 - DNA, 58 bp, Artificial Sequence
  Description of Artificial Sequence: Synthetic oligonucleotide
aattcaaaaagggcattgtgttcactgtactctcgagagtacagtgaacacaatgccc

SEQ ID NO: 2950 - DNA, 58 bp, Artificial Sequence
  Description of Artificial Sequence: Synthetic oligonucleotide
aattcaaaaacagatggaggttacacaacttctcgagaagttgtgtaacctccatctg

SEQ ID NO: 2951 - DNA, 58 bp, Artificial Sequence
  Description of Artificial Sequence: Synthetic oligonucleotide
aattcaaaaacctcacctacttcggactcttctcgagaagagtccgaagtaggtgagg

SEQ ID NO: 2952 - DNA, 58 bp, Artificial Sequence
  Description of Artificial Sequence: Synthetic oligonucleotide
aattcaaaaactgtactgtcaggtgcactttctcgagaaagtgcacctgacagtacag

SEQ ID NO: 2953 - DNA, 58 bp, Artificial Sequence
  Description of Artificial Sequence: Synthetic oligonucleotide
aattcaaaaagcgcaggcagatggaggttacctcgaggtaacctccatctgcctgcgc

SEQ ID NO: 2954 - DNA, 58 bp, Artificial Sequence
  Description of Artificial Sequence: Synthetic oligonucleotide
aattcaaaaacagttgccctctggttgagttctcgagaactcaaccagagggcaactg

SEQ ID NO: 2955 - DNA, 58 bp, Artificial Sequence
  Description of Artificial Sequence: Synthetic oligonucleotide
aattcaaaaaatggctctgctgacccaacaactcgagttgttgggtcagcagagccat

SEQ ID NO: 2956 - DNA, 58 bp, Artificial Sequence
  Description of Artificial Sequence: Synthetic oligonucleotide
aattcaaaaacccaacaaacagagctgcagactcgagtctgcagctctgtttgttggg

SEQ ID NO: 2957 - DNA, 58 bp, Artificial Sequence
  Description of Artificial Sequence: Synthetic oligonucleotide
aattcaaaaacctgaaacactacccaataatctcgagattattgggtagtgtttcagg

SEQ ID NO: 2958 - DNA, 58 bp, Artificial Sequence
  Description of Artificial Sequence: Synthetic oligonucleotide
aattcaaaaactacgccatgggacatctaatctcgagattagatgtcccatggcgtag

SEQ ID NO: 2959 - DNA, 58 bp, Artificial Sequence
  Description of Artificial Sequence: Synthetic oligonucleotide
aattcaaaaagtgactttgtttcgatgtattctcgagaatacatcgaaacaaagtcac

SEQ ID NO: 2960 - DNA, 58 bp, Artificial Sequence
  Description of Artificial Sequence: Synthetic oligonucleotide
aattcaaaaatcctgggagcagctgatacaactcgagttgtatcagctgctcccagga

SEQ ID NO: 2961 - DNA, 58 bp, Artificial Sequence
  Description of Artificial Sequence: Synthetic oligonucleotide
aattcaaaaagacagaccgacatcccattcactcgagtgaatgggatgtcggtctgtc

SEQ ID NO: 2962 - DNA, 58 bp, Artificial Sequence
  Description of Artificial Sequence: Synthetic oligonucleotide
aattcaaaaaatgggtctgacacgtggagaactcgagttctccacgtgtcagacccat

SEQ ID NO: 2963 - DNA, 58 bp, Artificial Sequence
  Description of Artificial Sequence: Synthetic oligonucleotide
aattcaaaaaattaagacactgatcactaaactcgagtttagtgatcagtgtcttaat

SEQ ID NO: 2964 - DNA, 58 bp, Artificial Sequence
  Description of Artificial Sequence: Synthetic oligonucleotide
aattcaaaaagtcgggagactacttcatttactcgagtaaatgaagtagtctcccgac

SEQ ID NO: 2965 - DNA, 58 bp, Artificial Sequence
  Description of Artificial Sequence: Synthetic oligonucleotide
aattcaaaaaactataggaggagagcaaatactcgagtatttgctctcctcctatagt

SEQ ID NO: 2966 - DNA, 58 bp, Artificial Sequence
  Description of Artificial Sequence: Synthetic oligonucleotide
aattcaaaaaccttcagttggctaatctttactcgagtaaagattagccaactgaagg

SEQ ID NO: 2967 - DNA, 58 bp, Artificial Sequence
  Description of Artificial Sequence: Synthetic oligonucleotide
aattcaaaaactgaacctccttgcgtgaatactcgagtattcacgcaaggaggttcag

SEQ ID NO: 2968 - DNA, 58 bp, Artificial Sequence
  Description of Artificial Sequence: Synthetic oligonucleotide
aattcaaaaaatgatacaaactctaacaaacctcgaggtttgttagagtttgtatcat

SEQ ID NO: 2969 - DNA, 58 bp, Artificial Sequence
  Description of Artificial Sequence: Synthetic oligonucleotide
aattcaaaaagtggcctctctgacttacaaactcgagtttgtaagtcagagaggccac

SEQ ID NO: 2970 - DNA, 58 bp, Artificial Sequence
  Description of Artificial Sequence: Synthetic oligonucleotide
aattcaaaaagcagaacaactcagtcatcatctcgagatgatgactgagttgttctgc

SEQ ID NO: 2971 - DNA, 58 bp, Artificial Sequence
  Description of Artificial Sequence: Synthetic oligonucleotide
aattcaaaaagccaagattcgagaggaacaactcgagttgttcctctcgaatcttggc

SEQ ID NO: 2972 - DNA, 58 bp, Artificial Sequence
  Description of Artificial Sequence: Synthetic oligonucleotide
aattcaaaaaactgtatggtcttgatctattctcgagaatagatcaagaccatacagt

SEQ ID NO: 2973 - DNA, 58 bp, Artificial Sequence
  Description of Artificial Sequence: Synthetic oligonucleotide
aattcaaaaacaaactacacagggtattaaactcgagtttaataccctgtgtagtttg

SEQ ID NO: 2974 - DNA, 58 bp, Artificial Sequence
  Description of Artificial Sequence: Synthetic oligonucleotide
aattcaaaaagtggatacattccagtacatactcgagtatgtactggaatgtatccac

SEQ ID NO: 2975 - DNA, 58 bp, Artificial Sequence; identical to SEQ ID NO: 2938
  Description of Artificial Sequence: Synthetic oligonucleotide

SEQ ID NO: 2976 - DNA, 58 bp, Artificial Sequence; identical to SEQ ID NO: 2939
  Description of Artificial Sequence: Synthetic oligonucleotide

SEQ ID NO: 2977 - DNA, 58 bp, Artificial Sequence; identical to SEQ ID NO: 2940
  Description of Artificial Sequence: Synthetic oligonucleotide

SEQ ID NO: 2978 - DNA, 58 bp, Artificial Sequence
  Description of Artificial Sequence: Synthetic oligonucleotide
aattcaaaaagccgttgttcagcgcaaatatctcgagatatttgcgctgaacaacggc

SEQ ID NO: 2979 - DNA, 58 bp, Artificial Sequence; identical to SEQ ID NO: 2978
  Description of Artificial Sequence: Synthetic oligonucleotide

SEQ ID NO: 2980 - DNA, 58 bp, Artificial Sequence
  Description of Artificial Sequence: Synthetic oligonucleotide
aattcaaaaaccgcatcaggtgaacatcaaactcgagtttgatgttcacctgatgcgg

SEQ ID NO: 2981 - DNA, 58 bp, Artificial Sequence
  Description of Artificial Sequence: Synthetic oligonucleotide
aattcaaaaaactcaatgatagcacctaaacctcgaggtttaggtgctatcattgagt

SEQ ID NO: 2982 - DNA, 58 bp, Artificial Sequence
  Description of Artificial Sequence: Synthetic oligonucleotide
aattcaaaaacgtcgcttcaatcgacctttactcgagtaaaggtcgattgaagcgacg

SEQ ID NO: 2983 - DNA, 58 bp, Artificial Sequence
  Description of Artificial Sequence: Synthetic oligonucleotide
aattcaaaaaccatctttattatggtcatatctcgagatatgaccataataaagatgg

SEQ ID NO: 2984 - DNA, 58 bp, Artificial Sequence
  Description of Artificial Sequence: Synthetic oligonucleotide
aattcaaaaagactgtgttggtatgtgtaatctcgagattacacataccaacacagtc

SEQ ID NO: 2985 - DNA, 58 bp, Artificial Sequence
  Description of Artificial Sequence: Synthetic oligonucleotide
aattcaaaaagcgccttattccagtgacaaactcgagtttgtcactggaataaggcgc

SEQ ID NO: 2986 - DNA, 58 bp, Artificial Sequence
  Description of Artificial Sequence: Synthetic oligonucleotide
aattcaaaaagaatcactgagctgtaacaaactcgagtttgttacagctcagtgattc

SEQ ID NO: 2987 - DNA, 58 bp, Artificial Sequence
  Description of Artificial Sequence: Synthetic oligonucleotide
aattcaaaaagcacatactgtgtggacaatactcgagtattgtccacacagtatgtgc

SEQ ID NO: 2988 - DNA, 58 bp, Artificial Sequence
  Description of Artificial Sequence: Synthetic oligonucleotide
aattcaaaaatgctgatgcagacattgaatactcgagtattcaatgtctgcatcagca

SEQ ID NO: 2989 - DNA, 58 bp, Artificial Sequence
  Description of Artificial Sequence: Synthetic oligonucleotide
aattcaaaaaagcgaggtattcaccacattcctcgaggaatgtggtgaatacctcgct

SEQ ID NO: 2990 - DNA, 58 bp, Artificial Sequence
  Description of Artificial Sequence: Synthetic oligonucleotide
aattcaaaaaagcttgactacgccgactttgctcgagcaaagtcggcgtagtcaagct

SEQ ID NO: 2991 - DNA, 58 bp, Artificial Sequence
  Description of Artificial Sequence: Synthetic oligonucleotide
aattcaaaaaagccaacaggctgcatgaaatctcgagatttcatgcagcctgttggct

SEQ ID NO: 2992 - DNA, 58 bp, Artificial Sequence
  Description of Artificial Sequence: Synthetic oligonucleotide
aattcaaaaagagatcctttcccatttattcctcgaggaataaatgggaaaggatctc

SEQ ID NO: 2993 - DNA, 58 bp, Artificial Sequence
  Description of Artificial Sequence: Synthetic oligonucleotide
aattcaaaaacaagatccgcagacgtgtaaactcgagtttacacgtctgcggatcttg

SEQ ID NO: 2994 - DNA, 58 bp, Artificial Sequence; identical to SEQ ID NO: 2993
  Description of Artificial Sequence: Synthetic oligonucleotide

SEQ ID NO: 2995 - DNA, 58 bp, Artificial Sequence
  Description of Artificial Sequence: Synthetic oligonucleotide
aattcaaaaagcgcaagaaatcccggtataactcgagttataccgggatttcttgcgc

SEQ ID NO: 2996 - DNA, 58 bp, Artificial Sequence
  Description of Artificial Sequence: Synthetic oligonucleotide
aattcaaaaaatgaatatgcggcactgaaagctcgagctttcagtgccgcatattcat

SEQ ID NO: 2997 - DNA, 58 bp, Artificial Sequence
  Description of Artificial Sequence: Synthetic oligonucleotide
aattcaaaaacattcccagaatgtgacatttctcgagaaatgtcacattctgggaatg

SEQ ID NO: 2998 - DNA, 58 bp, Artificial Sequence
  Description of Artificial Sequence: Synthetic oligonucleotide
aattcaaaaagagtgacctatgctgagctaactcgagttagctcagcataggtcactc

SEQ ID NO: 2999 - DNA, 58 bp, Artificial Sequence
  Description of Artificial Sequence: Synthetic oligonucleotide
aattcaaaaatgcgccctgatcagatgtatgctcgagcatacatctgatcagggcgca

SEQ ID NO: 3000 - DNA, 58 bp, Artificial Sequence
  Description of Artificial Sequence: Synthetic oligonucleotide
aattcaaaaaggacgtgctcaaggatgacaactcgagttgtcatccttgagcacgtcc

SEQ ID NO: 3001 - DNA, 58 bp, Artificial Sequence
  Description of Artificial Sequence: Synthetic oligonucleotide
aattcaaaaaagtgctgcatcaacgtgtgtgctcgagcacacacgttgatgcagcact

SEQ ID NO: 3002 - DNA, 58 bp, Artificial Sequence
  Description of Artificial Sequence: Synthetic oligonucleotide
aattcaaaaatcaagttcttgggcaccaagtctcgagacttggtgcccaagaacttga

SEQ ID NO: 3003 - DNA, 58 bp, Artificial Sequence
  Description of Artificial Sequence: Synthetic oligonucleotide
aattcaaaaatacaaccgctgctatatggacctcgaggtccatatagcagcggttgta

SEQ ID NO: 3004 - DNA, 58 bp, Artificial Sequence
  Description of Artificial Sequence: Synthetic oligonucleotide
aattcaaaaacaccagcttgctcagatattcctcgaggaatatctgagcaagctggtg

SEQ ID NO: 3005 - DNA, 58 bp, Artificial Sequence
  Description of Artificial Sequence: Synthetic oligonucleotide
aattcaaaaactgtcgagaaacggcgtttatctcgagataaacgccgtttctcgacag

SEQ ID NO: 3006 - DNA, 58 bp, Artificial Sequence
  Description of Artificial Sequence: Synthetic oligonucleotide
aattcaaaaagacctcgtctacttcgagaaactcgagtttctcgaagtagacgaggtc

SEQ ID NO: 3007 - DNA, 58 bp, Artificial Sequence
  Description of Artificial Sequence: Synthetic oligonucleotide
aattcaaaaagccacgagtttggatgttgtactcgagtacaacatccaaactcgtggc

SEQ ID NO: 3008 - DNA, 58 bp, Artificial Sequence
  Description of Artificial Sequence: Synthetic oligonucleotide
aattcaaaaaccacaaatggtcccaattaagctcgagcttaattgggaccatttgtgg

SEQ ID NO: 3009 - DNA, 58 bp, Artificial Sequence
  Description of Artificial Sequence: Synthetic oligonucleotide
aattcaaaaatcgggaatctgcctttgtttactcgagtaaacaaaggcagattcccga

SEQ ID NO: 3010 - DNA, 58 bp, Artificial Sequence
  Description of Artificial Sequence: Synthetic oligonucleotide
aattcaaaaattgactatgggatcaaatttgctcgagcaaatttgatcccatagtcaa

SEQ ID NO: 3011 - DNA, 58 bp, Artificial Sequence
  Description of Artificial Sequence: Synthetic oligonucleotide
aattcaaaaactcccaggacccgcttatttactcgagtaaataagcgggtcctgggag

SEQ ID NO: 3012 - DNA, 58 bp, Artificial Sequence
  Description of Artificial Sequence: Synthetic oligonucleotide
aattcaaaaacaaagaatgccagtatcaattctcgagaattgatactggcattctttg

SEQ ID NO: 3013 - DNA, 58 bp, Artificial Sequence
  Description of Artificial Sequence: Synthetic oligonucleotide
aattcaaaaacctgttcagatgtcagaagtactcgagtacttctgacatctgaacagg

SEQ ID NO: 3014 - DNA, 58 bp, Artificial Sequence
  Description of Artificial Sequence: Synthetic oligonucleotide
aattcaaaaacataggagaaggctcacaaatctcgagatttgtgagccttctcctatg

SEQ ID NO: 3015 - DNA, 58 bp, Artificial Sequence
  Description of Artificial Sequence: Synthetic oligonucleotide
aattcaaaaaggcgcaagcatcatctgtaacctcgaggttacagatgatgcttgcgcc

SEQ ID NO: 3016 - DNA, 58 bp, Artificial Sequence
  Description of Artificial Sequence: Synthetic oligonucleotide
aattcaaaaatcttcgggaaggagctcaaagctcgagctttgagctccttcccgaaga

SEQ ID NO: 3017 - DNA, 58 bp, Artificial Sequence
  Description of Artificial Sequence: Synthetic oligonucleotide
aattcaaaaagctgtgacaatggcaacaattctcgagaattgttgccattgtcacagc

SEQ ID NO: 3018 - DNA, 58 bp, Artificial Sequence
  Description of Artificial Sequence: Synthetic oligonucleotide
aattcaaaaattcaacttgtctctataatagctcgagctattatagagacaagttgaa

SEQ ID NO: 3019 - DNA, 58 bp, Artificial Sequence
  Description of Artificial Sequence: Synthetic oligonucleotide
aattcaaaaaagattctggctagtgtctatcctcgaggatagacactagccagaatct

SEQ ID NO: 3020 - DNA, 58 bp, Artificial Sequence
  Description of Artificial Sequence: Synthetic oligonucleotide
aattcaaaaaactgccagttagcagaatcaactcgagttgattctgctaactggcagt

SEQ ID NO: 3021 - DNA, 58 bp, Artificial Sequence
  Description of Artificial Sequence: Synthetic oligonucleotide
aattcaaaaagtagggagtgaagtctcacatctcgagatgtgagacttcactccctac

SEQ ID NO: 3022 - DNA, 58 bp, Artificial Sequence
  Description of Artificial Sequence: Synthetic oligonucleotide
aattcaaaaagaaatccaacaccagaaataactcgagttatttctggtgttggatttc

SEQ ID NO: 3023 - DNA, 58 bp, Artificial Sequence
  Description of Artificial Sequence: Synthetic oligonucleotide
aattcaaaaagatccgaccctgatgaatatgctcgagcatattcatcagggtcggatc

SEQ ID NO: 3024 - DNA, 58 bp, Artificial Sequence
  Description of Artificial Sequence: Synthetic oligonucleotide
aattcaaaaaatctgtctcctagaatcttatctcgagataagattctaggagacagat

SEQ ID NO: 3025 - DNA, 58 bp, Artificial Sequence
  Description of Artificial Sequence: Synthetic oligonucleotide
aattcaaaaaccctttatttatgacgactttctcgagaaagtcgtcataaataaaggg

SEQ ID NO: 3026 - protein, 108 aa, Artificial Sequence
  Description of Artificial Sequence: Synthetic polypeptide
DIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQ

SEQ ID NO: 3027 - protein, 118 aa, Artificial Sequence
  Description of Artificial Sequence: Synthetic polypeptide
QVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSS

SEQ ID NO: 3028 - protein, 14 aa, Artificial Sequence
  Description of Artificial Sequence: Synthetic peptide
EQKLISEEDLKDEL

SEQ ID NO: 3029 - protein, 26 aa, Artificial Sequence
  Description of Artificial Sequence: Synthetic peptide
GGGGSGGGGSGGGGSGGGGSAEKDEL

SEQ ID NO: 3030 - protein, 90 aa, Artificial Sequence
  Description of Artificial Sequence: Synthetic polypeptide
TTTPAPRPPTPAPTIASQPLSLRPEACRPAAGGAVHTRGLDFACDIYIWAPLAGTCGVLLLSLVITLYCNHRNLYKYKSRRSFIDEKKMP

SEQ ID NO: 3031 - protein, 22 aa, Artificial Sequence
  Description of Artificial Sequence: Synthetic peptide
GSGATNFSLLKQAGDVEENPGP

SEQ ID NO: 3032 - protein, 308 aa, Artificial Sequence; identical to SEQ ID NO: 10
  Description of Artificial Sequence: Synthetic polypeptide

SEQ ID NO: 3033 - protein, 123 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITRADAAPTVSIFPPSSN

SEQ ID NO: 3034 - protein, 120 aa, Artificial Sequence
  Description of Artificial Sequence: Synthetic polypeptide
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 3035 - protein, 45 aa, Artificial Sequence; identical to SEQ ID NO: 2
  Description of Artificial Sequence: Synthetic polypeptide

SEQ ID NO: 3036 - protein, 27 aa, Artificial Sequence
  Description of Artificial Sequence: Synthetic peptide
FWVLVVVGGVLACYSLLVTVAFIIFWV

SEQ ID NO: 3037 - protein, 41 aa, Artificial Sequence; identical to SEQ ID NO: 6
  Description of Artificial Sequence: Synthetic polypeptide

SEQ ID NO: 3038 - protein, 112 aa, Artificial Sequence; identical to SEQ ID NO: 7
  Description of Artificial Sequence: Synthetic polypeptide

SEQ ID NO: 3039 - protein, 259 aa, Artificial Sequence
  Description of Artificial Sequence: Synthetic polypeptide
MPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLG

SEQ ID NO: 3040 - protein, 103 aa, Artificial Sequence
  Description of Artificial Sequence: Synthetic polypeptide
YREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMDPI

SEQ ID NO: 3041 - protein, 103 aa, Artificial Sequence
  Description of Artificial Sequence: Synthetic polypeptide
YREGANDFVVTFNTSHLQKKYVKVLMHDVAYRQEKDENKWTHVNLSCTKLTLLQRKLQPAAMYEIKVRSIPDHYFKGFWSEWSPSYYFRTPEINNSSGEMDPI

SEQ ID NO: 3042 - protein, 61 aa, Artificial Sequence
  Description of Artificial Sequence: Synthetic polypeptide
VNLSSTKLTLLQRKLQPAAMYEIKVRSIPDHYFKGFWSEWSPSYYFRTPEINNSSGEMDPI

SEQ ID NO: 3043 - protein, 61 aa, Artificial Sequence
  Description of Artificial Sequence: Synthetic polypeptide
VNLSCTKLTLLQRKLQPAAMYEIKVRSIPDHYFKGFWSEWSPSYYFRTPEINNSSGEMDPI

SEQ ID NO: 3044 - protein, 13 aa, Artificial Sequence
  Description of Artificial Sequence: Synthetic peptide
PEINNSSGEMDPI

SEQ ID NO: 3045 - protein, 26 aa, Artificial Sequence
  Description of Artificial Sequence: Synthetic peptide
LLTCPTISILSFFSVALLVILACVLW

SEQ ID NO: 3046 - protein, 23 aa, Artificial Sequence
  Description of Artificial Sequence: Synthetic peptide
LLTISILSFFSVALLVILACVLW

SEQ ID NO: 3047 - protein, 195 aa, Artificial Sequence
  Description of Artificial Sequence: Synthetic polypeptide
KKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 3048 - DNA, 130 bp, Artificial Sequence; identical to SEQ ID NO: 55
  Description of Artificial Sequence: Synthetic polynucleotide

SEQ ID NO: 3049 - DNA, 1000 bp, Artificial Sequence; identical to SEQ ID NO: 54
  Description of Artificial Sequence: Synthetic polynucleotide

SEQ ID NO: 3050 - DNA, 232 bp, Artificial Sequence; identical to SEQ ID NO: 52
  Description of Artificial Sequence: Synthetic polynucleotide

SEQ ID NO: 3051 - DNA, 927 bp, Artificial Sequence; identical to SEQ ID NO: 53
  Description of Artificial Sequence: Synthetic polynucleotide

SEQ ID NO: 3052 - DNA, 510 bp, Artificial Sequence
  Description of Artificial Sequence: Synthetic polynucleotide
acgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccga

SEQ ID NO: 3053 - DNA, 1000 bp, Artificial Sequence
  Description of Artificial Sequence: Synthetic polynucleotide
cgtctcctgaacctgagtagagacactgctgctgagatggtaagtgagagaatgtgggcctgtgcctaggccacccagctggcccctgactggccacgcctgtcagcttgataacatgacattttccttttctacagaatgaaacagtagaagtcatctcagaaatgtttgacctccaggtaagatgcttctctctgacatagctttccagaagcccctgccctggggtggaggtggggactccattttagatggcaccacacagggttgtccactttctctccagtcagctggctgcaggaggagggggtagcaactgggtgctcaagaggctgctggccgtgcccctatggcagtcacatgagctcctttatcagctgagcggccatgggcagacctagcattcaatggccaggagtcaccaggggacaggtggtaaagtgggggtcacttcatgagacaggagctgtgggtttggggcgctcactgtgccccgagaccaagtcctgttgagacagtgctgactacagagaggcacagaggggtttcaggaacaacccttgcccacccagcaggtccaggtgaggccccacccccctctccctgaatgatggggtgagagtcacctccttccctaaggctgggctcctctccaggtgccgctgagggtggcctgggcggggcagtgagaagggcaggttcgtgcctgccatggacagggcagggtctatgactggacccagcctgtgcccctcccaagccctactcctgggggctgggggcagcagcaaaaaggagtggtggagagttcttgtaccactgtgggcacttggccactgctcaccgacgaacgacattttccacaggagccgacctgcctacagacccgcctggagctgtacaagcagggcctgcggggcagcctcaccaagctcaagggccccttgaccatgatggccagccactacaagcagcactgccctccaaccccggtgagtgc

SEQ ID NO: 3054 - DNA, 3940 bp, Artificial Sequence
  Description of Artificial Sequence: Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctcctgagatggatgcagccacagccctggagccagcctgaagctcctggtgtcttctgggggctacatataggagtgtagtccgaacctcagaggggcaaacctgctctgcagagggaatcaaggttcacataaccagagaggggagtcactcaggaaggtggctccagagccaagagtcagactctgggtcccgacttgacccagccacaccccctctgaagcttgctgagagtggctgcagtctcgctgctggatgtgcacatggtggtcattccctctgctcacaggggcaggggtccccccttactggactgaggttgccccctgctccaggtcctgggtgggagcccatgtgaactgtcagtggggcaggtctgtgagagctcccctcacactcaagtctctcacagtggccagagaagaggaaggctggagtcagaatgaggcaccagggcgggcatagcctgcccaaaggcccctgggattacaggcaggatggggagccctatctaagtgtctcccacgccccaccccagccattccaggccaggaagtccaaactgtgcccctcagagggagggggcagcctcaggcccattcagactgcccagggagggctggagagccctcaggaaggcgggtgggtgggctgtcggttcttggaaaggttcattaatgaaaacccccaagcctgaccacctagggaaaaggctcaccgttcccatgtgtggctgataagggccaggagattccacagttcaggtagttcccccgcctccctggcattttgtggtcaccattaatcatttcctctgtgtatttaagagctcttttgccagtgagcccagtacacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggcccggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccatttaaacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgacgtctcctgaacctgagtagagacactgctgctgagatggtaagtgagagaatgtgggcctgtgcctaggccacccagctggcccctgactggccacgcctgtcagcttgataacatgacattttccttttctacagaatgaaacagtagaagtcatctcagaaatgtttgacctccaggtaagatgcttctctctgacatagctttccagaagcccctgccctggggtggaggtggggactccattttagatggcaccacacagggttgtccactttctctccagtcagctggctgcaggaggagggggtagcaactgggtgctcaagaggctgctggccgtgcccctatggcagtcacatgagctcctttatcagctgagcggccatgggcagacctagcattcaatggccaggagtcaccaggggacaggtggtaaagtgggggtcacttcatgagacaggagctgtgggtttggggcgctcactgtgccccgagaccaagtcctgttgagacagtgctgactacagagaggcacagaggggtttcaggaacaacccttgcccacccagcaggtccaggtgaggccccacccccctctccctgaatgatggggtgagagtcacctccttccctaaggctgggctcctctccaggtgccgctgagggtggcctgggcggggcagtgagaagggcaggttcgtgcctgccatggacagggcagggtctatgactggacccagcctgtgcccctcccaagccctactcctgggggctgggggcagcagcaaaaaggagtggtggagagttcttgtaccactgtgggcacttggccactgctcaccgacgaacgacattttccacaggagccgacctgcctacagacccgcctggagctgtacaagcagggcctgcggggcagcctcaccaagctcaagggccccttgaccatgatggccagccactacaagcagcactgccctccaaccccggtgagtgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 3055 - DNA, 21 bp, Artificial Sequence
  Description of Artificial Sequence: Synthetic oligonucleotide
gcggccgcatcgattgaattc

SEQ ID NO: 3056 - DNA, 999 bp, Artificial Sequence
  Description of Artificial Sequence: Synthetic polynucleotide
aggtaagtccacgaatcagtgattcagtggtgtggagagctttatttctgagaaggccagtagcgctcccttctgacaagcaaatctaagacctggatgacagatgacttcctgcatttggttggttcttttgtcattcatatctatctgtaatacagttctggctaatttaagaggataagcttgaagacctctggaatttttcggctttaggactttaaggctttctgagcttcagtagatctagatctaggagctcatgctggtatattctgaatccgatgtatctgagttacatctatgagctacttaataaatatatctatgagctaaatctcataggctaagcatgaacctcacctccaagactcggggttcctaaatggatgagaccctctttgggaagtcttgtgggcagtgtctaattccactagaaaagttttacctacaatttaaacttaaaccatgatattttcttactgctgtttccttttttcattttcaggtggtattacacagacacgtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaaccctaaagccacctctcaaaaggttctctagttcccttcaaggttctctagttcccttcattccacatatctcctcttccacaccctctagccagtagagctcccttctgacaagcaagtctaagatctagatgacagatgacttcctgcatttgggtggttcttttgtcactaatttgccttttctaaaattgtcctggtttcttctgccaatttcccttctttctccccagcatataaagtctccatctctggaaccaca

SEQ ID NO: 3057 - DNA, 2496 bp, Artificial Sequence
  Description of Artificial Sequence: Synthetic polynucleotide
atggccttaccagtgaccgccttgctcctgccgctggccttgctgctccacgccgccaggccggatatccagatgacacagactacatcctccctgtctgcctctctgggagacagagtcaccatcagttgcagtgcaagtcagggcattagcaattatttaaactggtatcagcagaaaccagatggaactgttaaactcctgatctattacacatcaagtttacactcaggagtcccatcaaggttcagtggcagtgggtctgggacagattattctctcaccatcagcaacctggaacctgaagatattgccacttattattgtcagcagtatagcaagcttccgtacacgttcggaggggggaccaagctggaaataaaacgtggtggtggtggttctggtggtggtggttctggcggcggcggctccggtggtggtggatccgaggtgcaactggtggagtctgggggaggcttagtgaagcctggggggtccctgaaactctcctgtgcagcctctggactcactttcagtagctatgccatgtcttgggttcgccagactccagagaagaggctggagtgggtcgcatccattagtagtggtggtttcacctactatccagacagtgtgaagggccgattcaccatctccagagataatgccaggaacatcctgtatctgcaaatgagcagtctgaggtctgaggacacggccatgtattactgtgcaagagacgaggtacgggggtacctcgatgtctggggcgcagggaccacggtcaccgtttcccctagggctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgccggaccgatggaagcggagctactaacttcagcctgctgaagcaggctggagacgtggaggagaaccctggacctgtttctgaagccatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccatttaa

SEQ ID NO: 3058 - DNA, 720 bp, Artificial Sequence
  Description of Artificial Sequence: Synthetic polynucleotide
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 3059 - DNA, 499 bp, Artificial Sequence
  Description of Artificial Sequence: Synthetic polynucleotide
acgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccac

SEQ ID NO: 3060 - DNA, 1003 bp, Artificial Sequence
  Description of Artificial Sequence: Synthetic polynucleotide
agtataatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaacc

SEQ ID NO: 3061 - DNA, 17 bp, Artificial Sequence
  Description of Artificial Sequence: Synthetic oligonucleotide
gcggaccgagcggccgc

SEQ ID NO: 3062 - DNA, 141 bp, Artificial Sequence; identical to SEQ ID NO: 51
  Description of Artificial Sequence: Synthetic polynucleotide

SEQ ID NO: 3063 - DNA, 3530 bp, Artificial Sequence
  Description of Artificial Sequence: Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcatcgattgaattcaggtaagtccacgaatcagtgattcagtggtgtggagagctttatttctgagaaggccagtagcgctcccttctgacaagcaaatctaagacctggatgacagatgacttcctgcatttggttggttcttttgtcattcatatctatctgtaatacagttctggctaatttaagaggataagcttgaagacctctggaatttttcggctttaggactttaaggctttctgagcttcagtagatctagatctaggagctcatgctggtatattctgaatccgatgtatctgagttacatctatgagctacttaataaatatatctatgagctaaatctcataggctaagcatgaacctcacctccaagactcggggttcctaaatggatgagaccctctttgggaagtcttgtgggcagtgtctaattccactagaaaagttttacctacaatttaaacttaaaccatgatattttcttactgctgtttccttttttcattttcaggtggtattacacagacacgtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaaccctaaagccacctctcaaaaggttctctagttcccttcaaggttctctagttcccttcattccacatatctcctcttccacaccctctagccagtagagctcccttctgacaagcaagtctaagatctagatgacagatgacttcctgcatttgggtggttcttttgtcactaatttgccttttctaaaattgtcctggtttcttctgccaatttcccttctttctccccagcatataaagtctccatctctggaaccacaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaaacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacagtataatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 3064 - DNA, 5306 bp, Artificial Sequence
  Description of Artificial Sequence: Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcatcgattgaattcaggtaagtccacgaatcagtgattcagtggtgtggagagctttatttctgagaaggccagtagcgctcccttctgacaagcaaatctaagacctggatgacagatgacttcctgcatttggttggttcttttgtcattcatatctatctgtaatacagttctggctaatttaagaggataagcttgaagacctctggaatttttcggctttaggactttaaggctttctgagcttcagtagatctagatctaggagctcatgctggtatattctgaatccgatgtatctgagttacatctatgagctacttaataaatatatctatgagctaaatctcataggctaagcatgaacctcacctccaagactcggggttcctaaatggatgagaccctctttgggaagtcttgtgggcagtgtctaattccactagaaaagttttacctacaatttaaacttaaaccatgatattttcttactgctgtttccttttttcattttcaggtggtattacacagacacgtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaaccctaaagccacctctcaaaaggttctctagttcccttcaaggttctctagttcccttcattccacatatctcctcttccacaccctctagccagtagagctcccttctgacaagcaagtctaagatctagatgacagatgacttcctgcatttgggtggttcttttgtcactaatttgccttttctaaaattgtcctggtttcttctgccaatttcccttctttctccccagcatataaagtctccatctctggaaccacaatggccttaccagtgaccgccttgctcctgccgctggccttgctgctccacgccgccaggccggatatccagatgacacagactacatcctccctgtctgcctctctgggagacagagtcaccatcagttgcagtgcaagtcagggcattagcaattatttaaactggtatcagcagaaaccagatggaactgttaaactcctgatctattacacatcaagtttacactcaggagtcccatcaaggttcagtggcagtgggtctgggacagattattctctcaccatcagcaacctggaacctgaagatattgccacttattattgtcagcagtatagcaagcttccgtacacgttcggaggggggaccaagctggaaataaaacgtggtggtggtggttctggtggtggtggttctggcggcggcggctccggtggtggtggatccgaggtgcaactggtggagtctgggggaggcttagtgaagcctggggggtccctgaaactctcctgtgcagcctctggactcactttcagtagctatgccatgtcttgggttcgccagactccagagaagaggctggagtgggtcgcatccattagtagtggtggtttcacctactatccagacagtgtgaagggccgattcaccatctccagagataatgccaggaacatcctgtatctgcaaatgagcagtctgaggtctgaggacacggccatgtattactgtgcaagagacgaggtacgggggtacctcgatgtctggggcgcagggaccacggtcaccgtttcccctagggctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgccggaccgatggaagcggagctactaacttcagcctgctgaagcaggctggagacgtggaggagaaccctggacctgtttctgaagccatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccatttaaacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacagtataatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 3065 - protein, 5 aa, Artificial Sequence
  Description of Artificial Sequence: Synthetic peptide
GGGGS

SEQ ID NO: 3066 - protein, 20 aa, Artificial Sequence
  Description of Artificial Sequence: Synthetic peptide
  MISC_FEATURE (1)..(20): This sequence may encompass 3-4 "Gly Gly Gly Gly Ser" repeating units
GGGGSGGGGSGGGGSGGGGS

SEQ ID NO: 3067 - protein, 50 aa, Artificial Sequence
  Description of Artificial Sequence: Synthetic polypeptide
GGGGSGGGGSGGGGSGGGGSGGGGSGGGGSGGGGSGGGGSGGGGSGGGGS

SEQ ID NO: 3068 - protein, 45 aa, Artificial Sequence
  Description of Artificial Sequence: Synthetic polypeptide
GGGGSGGGGSGGGGSGGGGSGGGGPGGGGSGGGGSGGGGSGGGGS

SEQ ID NO: 3069 - protein, 20 aa, Artificial Sequence
  Description of Artificial Sequence: Synthetic peptide
  MISC_FEATURE (1)..(20): This sequence may encompass 1-4 "Gly Gly Gly Gly Ser" repeating units
GGGGSGGGGSGGGGSGGGGS

SEQ ID NO: 3070 - protein, 5 aa, Artificial Sequence
  Description of Artificial Sequence: Synthetic peptide
WSEWS

SEQ ID NO: 3071 - protein, 281 aa, Artificial Sequence
  Description of Artificial Sequence: Synthetic polypeptide
  MISC_FEATURE (130)..(149): This region may encompass 1-4 "Gly Gly Gly Gly Ser" repeating units
MALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSEQKLISEEDLKDEL

SEQ ID NO: 3072 - protein, 293 aa, Artificial Sequence
  Description of Artificial Sequence: Synthetic polypeptide
  MISC_FEATURE (130)..(149): This region may encompass 1-4 "Gly Gly Gly Gly Ser" repeating units
MALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSGGGGSGGGGSGGGGSGGGGSAEKDEL

SEQ ID NO: 3073 - protein, 357 aa, Artificial Sequence
  Description of Artificial Sequence: Synthetic polypeptide
  MISC_FEATURE (130)..(149): This region may encompass 1-4 "Gly Gly Gly Gly Ser" repeating units
MALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSTTTPAPRPPTPAPTIASQPLSLRPEACRPAAGGAVHTRGLDFACDIYIWAPLAGTCGVLLLSLVITLYCNHRNLYKYKSRRSFIDEKKMP

SEQ ID NO: 3074 - protein, 611 aa, Artificial Sequence
  Description of Artificial Sequence: Synthetic polypeptide
  MISC_FEATURE (130)..(149): This region may encompass 1-4 "Gly Gly Gly Gly Ser" repeating units
MALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSEQKLISEEDLKDELGSGATNFSLLKQAGDVEENPGPMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

SEQ ID NO: 3075 - protein, 623 aa, Artificial Sequence
  Description of Artificial Sequence: Synthetic polypeptide
  MISC_FEATURE (130)..(149): This region may encompass 1-4 "Gly Gly Gly Gly Ser" repeating units
MALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSGGGGSGGGGSGGGGSGGGGSAEKDELGSGATNFSLLKQAGDVEENPGPMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

SEQ ID NO: 3076 - protein, 687 aa, Artificial Sequence
  Description of Artificial Sequence: Synthetic polypeptide
  MISC_FEATURE (130)..(149): This region may encompass 1-4 "Gly Gly Gly Gly Ser" repeating units
MALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSTTTPAPRPPTPAPTIASQPLSLRPEACRPAAGGAVHTRGLDFACDIYIWAPLAGTCGVLLLSLVITLYCNHRNLYKYKSRRSFIDEKKMPGSGATNFSLLKQAGDVEENPGPMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

SEQ ID NO: 3077 - protein, 812 aa, Artificial Sequence
  Description of Artificial Sequence: Synthetic polypeptide
  MISC_FEATURE (661)..(680): This region may encompass 1-4 "Gly Gly Gly Gly Ser" repeating units
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITRADAAPTVSIFPPSSNGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSEQKLISEEDLKDEL

SEQ ID NO: 3078 - protein, 824 aa, Artificial Sequence
  Description of Artificial Sequence: Synthetic polypeptide
  MISC_FEATURE (661)..(680): This region may encompass 1-4 "Gly Gly Gly Gly Ser" repeating units
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITRADAAPTVSIFPPSSNGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSGGGGSGGGGSGGGGSGGGGSAEKDEL

SEQ ID NO: 3079 - protein, 888 aa, Artificial Sequence
  Description of Artificial Sequence: Synthetic polypeptide
  MISC_FEATURE (661)..(680): This region may encompass 1-4 "Gly Gly Gly Gly Ser" repeating units
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITRADAAPTVSIFPPSSNGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSTTTPAPRPPTPAPTIASQPLSLRPEACRPAAGGAVHTRGLDFACDIYIWAPLAGTCGVLLLSLVITLYCNHRNLYKYKSRRSFIDEKKMP

SEQ ID NO: 3080 - protein, 1142 aa, Artificial Sequence
  Description of Artificial Sequence: Synthetic polypeptide
  MISC_FEATURE (661)..(680): This region may encompass 1-4 "Gly Gly Gly Gly Ser" repeating units
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITRADAAPTVSIFPPSSNGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSEQKLISEEDLKDELGSGATNFSLLKQAGDVEENPGPMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

SEQ ID NO: 3081 - protein, 1154 aa, Artificial Sequence
  Description of Artificial Sequence: Synthetic polypeptide
  MISC_FEATURE (661)..(680): This region may encompass 1-4 "Gly Gly Gly Gly Ser" repeating units
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITRADAAPTVSIFPPSSNGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSGGGGSGGGGSGGGGSGGGGSAEKDELGSGATNFSLLKQAGDVEENPGPMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

SEQ ID NO: 3082 - protein, 1218 aa, Artificial Sequence
  Description of Artificial Sequence: Synthetic polypeptide
  MISC_FEATURE (661)..(680): This region may encompass 1-4 "Gly Gly Gly Gly Ser" repeating units
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITRADAAPTVSIFPPSSNGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIELTQPPSVSVAPGQTARISCSGDNLPGKYVHWYQQKPGQAPVLVIYYDSNRPSGIPERFSGSNSGNTATLTISGTQAEDEADYYCQSRTQTTIVFGGGTKLTVLGQGGGGSGGGGSGGGGSGGGGSQVQLVESGGGLVQPGGSLRLSCAASGFTFSSHWMSWVRQAPGKGLEWVSNIWRGPYIYYADSVKGRFTISRDNSKNTLYLQMNSLRAEDTAVYYCARFQGYGGGFDYWGQGTLVTVSSTTTPAPRPPTPAPTIASQPLSLRPEACRPAAGGAVHTRGLDFACDIYIWAPLAGTCGVLLLSLVITLYCNHRNLYKYKSRRSFIDEKKMPGSGATNFSLLKQAGDVEENPGPMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPI

What is claimed is:

1. A chimeric antigen receptor (CAR)-bearing effector T cell that is deficient in CD40LG.

2. The cell as recited in claim 1, wherein the CD40LG deficiency is effected by deletion or suppression of a gene encoding CD40LG, or by suppression of a gene transcript of CD40LG.

3. The cell as recited in claim 2, wherein the deletion or suppression of the gene encoding CD40LG effected by inserting a nucleic acid encoding the CAR into a locus of the CD40LG gene, or wherein the suppression of the gene transcript of CD40LG is effected by transfection of one or more types of small interfering RNAs (siRNA) or by transduction of one or more types of short hairpin RNAs (shRNA).

4. The cell as recited in claim 3, wherein the CAR is part of a construct that also includes a selectable marker chosen from a green fluorescence (GFP) gene, a YFP gene, a tCD34 gene, or a tEGFR gene.

5. The cell as recited in claim 2, wherein deletion or suppression is effected using CRISPR, Cas9-CRISPR, Transcription Activator-like Effector Nucleases (TALENs), Zinc Finger Nucleases (ZFNs), or Clustered Regularly Interspaced Short Palindromic Repeats (CRISPR).

6. The cell as recited in claim 5, wherein the Cas9 is delivered into the cell as mRNA or protein, and/or wherein a guide RNA (gRNA) targeting the gene to be deleted or suppressed is delivered contemporaneously with the Cas9.

7. The cell as recited in claim 6, wherein the gRNA targeting the gene comprises the nucleotide sequence set forth in one of SEQ ID NO: 252, SEQ ID NO: 253, and SEQ ID NO: 254.

8. The cell of claim 2, wherein:
the cell expresses at least one CAR, wherein the nucleic acid encoding the CAR is inserted into a locus of the CD40LG gene;
the gene encoding CD40LG is deleted or suppressed by a method chosen from Transcription Activator-like Effector Nucleases (TALENs), Zinc Finger Nucleases (ZFNs), and Clustered Regularly Interspaces Short Palindromic Repeats (CRISPR) editing;
CD40LG is suppressed by expression of an scFv with an endoplasmic reticulum (ER) binding tether to bind in the ER and prevent secretion;
the CD40LG gene transcript is suppressed by transfection of small interfering RNAs (siRNAs);
the CD40LG gene transcript is suppressed by transduction of short hairpin RNAs (shRNAs).

9. The cell as recited in claim 1, wherein the chimeric antigen receptor(s) specifically binds at least one antigen expressed on a malignant cell, a malignant T cell, a malignant B cell, a malignant mesothelial cell, or a malignant plasma cell.

10. The cell as recited in claim 9, wherein the at least one antigen expressed on a malignant cell is chosen from BCMA, CS1, CD38, CD138, CD19, CD33, CD123, CD371, CD117, CD135, Tim-3, CD5, CD7, CD2, CD4, CD3, CD79A, CD79B, APRIL, CD56, and CD1a; or
wherein the at least one antigen expressed on a malignant T cell is chosen from CD2, CD38, CD4, CD5, CD7, TCRA, and TCRβ; or
wherein the at least one antigen expressed on a malignant B cell is chosen from CD19, CD20, CD21, CD22, CD23, CD24, CD25, CD27, CD38, and CD45; or
wherein the at least one antigen expressed on a malignant mesothelial cell is mesothelin; or
wherein the at least one antigen expressed on a malignant plasma cell is chosen from BCMA, CS1, CD38, and CD19.

11. The cell as recited in claim 9, wherein the chimeric antigen receptor expresses the extracellular portion of the APRIL protein, the ligand for BCMA and TACI, effectively co-targeting both BCMA and TACI.

12. The cell as recited in claim 1, wherein endogenous T cell receptor mediated signaling is negligible in the cell.

13. The cell as recited in claim 12, wherein the cell does not induce alloreactivity, graft-versus-host disease, or fratricide.

14. A method of treatment of cancer in a patient, which has a reduced incidence of cytokine release syndrome and/or CAR-T associated neuropathy, comprising the administration of cells as recited in claim 1.

15. The method as recited in claim 14, wherein the cancer is a hematologic malignancy chosen from a T-cell malignancy, multiple myeloma, or acute myeloid leukemia (AML), or a solid tumor chosen from cervical cancer, pancreatic cancer, ovarian cancer, mesothelioma, or lung cancer.

* * * * *